United States Patent 12,577,609 (METHODS FOR CELL-TYPE SPECIFIC PROFILING TO IDENTIFY DRUG TARGETS) - sequence listing, part 18

SEQ ID NO: 26853 - protein, 148 aa, Homo sapiens
  ENSP00000479908
  MOD_RES (1)..(1): Any amino acid
XQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVELASVLG

SEQ ID NO: 26854 - protein, 297 aa, Homo sapiens
  ENSP00000372262
MLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 26855 - protein, 319 aa, Homo sapiens
  ENSP00000298248
MASSAAGCVVIVGSGVIGRSWAMLFASGGFQVKLYDIEQQQIRNALENIRKEMKLLEQAGSLKGSLSVEEQLSLISGCPNIQEAVEGAMHIQECVPEDLELKKKIFAQLDSIIDDRVILSSSTSCLMPSKLFAGLVHVKQCIVAHPVNPPYYIPLVELVPHPETAPTTVDRTHALMKKIGQCPMRVQKEVAGFVLNRLQYAIISEAWRLVEEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 26856 - protein, 165 aa, Homo sapiens
  ENSP00000459982
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVI

SEQ ID NO: 26857 - protein, 97 aa, Homo sapiens
  ENSP00000460820
  MOD_RES (1)..(1): Any amino acid
XVGASRPDWRELDDELMKEAVLYVDSQEAALKESGDVLLSGAEIFAELGEVIKGVKPAHCEKTTVFKSLGMAVEDTVAAKLIYDSWSSAAPISLNLK

SEQ ID NO: 26858 - protein, 314 aa, Homo sapiens
  ENSP00000219599
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAHCEKTTVFKSLGMAVEDTVAAKLIYDSWSSGK

SEQ ID NO: 26859 - protein, 241 aa, Homo sapiens
  ENSP00000460126
MQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLCILGAGVQAYSHYEIFTEQFSFKEVRIWNRTKENAEKFADTVQGEVRVCSSVQEAVAGADVIITVTLATEPILFGEWVKPGAHINAVGASRPDWRELDDELMKEAVLYVDSQEAALKESGDVLLSGAEIFAELGEVIKGVKPAH

SEQ ID NO: 26860 - protein, 140 aa, Homo sapiens
  ENSP00000461904
MSRVPAFLSAAEVEEHLRSSSLLIPPLETALANFSSGPEGGVMQPVRTVVPVTKHRGYLGVMPAYSAAEDALTTKLVTFYEDRGITSVVPSHQATVLLFEPSNGTLLAVMDGNVITAKRTAAVSAIATKFLKPPSSEVLC

SEQ ID NO: 26861 - protein, 25 aa, Homo sapiens
  ENSP00000460510
MSRVPAFLSAAEVEEHLRSSSLLIP

SEQ ID NO: 26862 - protein, 314 aa, Homo sapiens; identical to SEQ ID NO: 26858
  ENSP00000440227

SEQ ID NO: 26863 - protein, 165 aa, Homo sapiens; identical to SEQ ID NO: 26856
  ENSP00000492884

SEQ ID NO: 26864 - protein, 97 aa, Homo sapiens; identical to SEQ ID NO: 26857
  ENSP00000491775
  MOD_RES (1)..(1): Any amino acid

SEQ ID NO: 26865 - protein, 314 aa, Homo sapiens; identical to SEQ ID NO: 26858
  ENSP00000490961

SEQ ID NO: 26866 - protein, 314 aa, Homo sapiens; identical to SEQ ID NO: 26858
  ENSP00000492104

SEQ ID NO: 26867 - protein, 241 aa, Homo sapiens; identical to SEQ ID NO: 26859
  ENSP00000491052

SEQ ID NO: 26868 - protein, 140 aa, Homo sapiens; identical to SEQ ID NO: 26860
  ENSP00000491368

SEQ ID NO: 26869 - protein, 25 aa, Homo sapiens
  ENSP00000492312
MSRVPAFLSAAEVEEHLRSSSLLIP

SEQ ID NO: 26870 - protein, 671 aa, Homo sapiens
  ENSP00000422212
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGTVASPARVWTPMWR

SEQ ID NO: 26871 - protein, 972 aa, Homo sapiens
  ENSP00000286301
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 26872 - protein, 64 aa, Homo sapiens
  ENSP00000427545
AGSPWALGQRPFGAQGLKGPVCVAATAHADEKEALMSELKIMSHLGQHENIVNLLGACTHGGIS

SEQ ID NO: 26873 - protein, 49 aa, Homo sapiens
  ENSP00000421174
MRHTNYSFSPWHGFTIHRAKFIQSQDYQCSALMGGRKVMSISIRLKVQK

SEQ ID NO: 26874 - protein, 306 aa, Homo sapiens
  ENSP00000445282
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVGTPSPSLCPA

SEQ ID NO: 26875 - protein, 2967 aa, Homo sapiens
  ENSP00000334828
  MOD_RES (1)..(1): Any amino acid
XEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKIPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 26876 - protein, 3388 aa, Homo sapiens
  ENSP00000383047
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 26877 - protein, 3388 aa, Homo sapiens; identical to SEQ ID NO: 26876
  ENSP00000473617

SEQ ID NO: 26878 - protein, 3564 aa, Homo sapiens
  ENSP00000489225
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 26879 - protein, 3565 aa, Homo sapiens
  ENSP00000430733
MTAWRRFQSLLLLLGLLVLCARLLTAAKGQNCGGLVQGPNGTIESPGFPHGYPNYANCTWIIITGERNRIQLSFHTFALEEDFDILSVYDGQPQQGNLKVRLSGFQLPSSIVSTGSILTLWFTTDFAVSAQGFKALYEVLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFSRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 26880 - protein, 3565 aa, Homo sapiens; identical to SEQ ID NO: 26879
  ENSP00000473359

SEQ ID NO: 26881 - protein, 3426 aa, Homo sapiens
  ENSP00000441462
VLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 26882 - protein, 2967 aa, Homo sapiens; identical to SEQ ID NO: 26875
  ENSP00000334828
  MOD_RES (1)..(1): Any amino acid

SEQ ID NO: 26883 - protein, 3388 aa, Homo sapiens; identical to SEQ ID NO: 26876
  ENSP00000383047

SEQ ID NO: 26884 - protein, 3388 aa, Homo sapiens; identical to SEQ ID NO: 26876
  ENSP00000473617

SEQ ID NO: 26885 - protein, 3564 aa, Homo sapiens; identical to SEQ ID NO: 26878
  ENSP00000489225

SEQ ID NO: 26886 - protein, 3565 aa, Homo sapiens; identical to SEQ ID NO: 26879
  ENSP00000430733

SEQ ID NO: 26887 - protein, 3565 aa, Homo sapiens; identical to SEQ ID NO: 26879
  ENSP00000473359

SEQ ID NO: 26888 - protein, 3426 aa, Homo sapiens; identical to SEQ ID NO: 26881
  ENSP00000441462

SEQ ID NO: 26889 - protein, 3487 aa, Homo sapiens
  ENSP00000241312
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQDLTYSHQISSFLRGFDLSELERTNSTPPVAASYVWDLDPGCEAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 26890 - protein, 1167 aa, Homo sapiens
  ENSP00000362478
MVIVILFPAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSGHLAAVCTL

SEQ ID NO: 26891 - protein, 426 aa, Homo sapiens
  ENSP00000362475
MLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSDHCRYFNQKSGKLDFTPSSTLGQLCKTLHRSLPHLRLQFLHL

SEQ ID NO: 26892 - protein, 225 aa, Homo sapiens
  ENSP00000340311
MCDAHLRGPSGIITSPNFPIQYDNNAHCVWIITALNPSKAGGDPGNIQCNKEGLSVETQSLRLRNRSCLLGNSKDNGCCVPNPVHGTGLQVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVCK

SEQ ID NO: 26893 - protein, 3487 aa, Homo sapiens; identical to SEQ ID NO: 26889
  ENSP00000362486

SEQ ID NO: 26894 - protein, 3631 aa, Homo sapiens
  ENSP00000362479
MPRSRGRELGRCGCPAGRARGETGISALVPGAGSRWGRPPPPTPPPLLLLLGCGLLSVSAAAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLATQTKLHSIFYKLLFDVLSSPSLTKAGHCGTPEPIVNGHINGENYSYRGSVVYQCNAGFRLIGMSVRICQQDHHWSGKTPFCVPITCGHPGNPVNGLTQGNQFNLNDVVKFVCNPGYMAEGAARSQCLASGQWSDMLPTCRIINCTDPGHQENSVRQVHASGPHRFSFGTTVSYRCNHGFYLLGTPVLSCQGDGTWDRPRPQCLLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 26895 - protein, 3591 aa, Homo sapiens
  ENSP00000483463
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLATQTKLHSIFYKLLFDVLSSPSLTKAGHCGTPEPIVNGHINGENYSYRGSVVYQCNAGFRLIGMSVRICQQDHHWSGKTPFCVPITCGHPGNPVNGLTQGNQFNLNDVVKFVCNPGYMAEGAARSQCLASGQWSDMLPTCRIINCTDPGHQENSVRQVHASGPHRFSFGTTVSYRCNHGFYLLGTPVLSCQGDGTWDRPRPQCLLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 26896 - protein, 2322 aa, Homo sapiens
  ENSP00000312506
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 26897 - protein, 2322 aa, Homo sapiens; identical to SEQ ID NO: 26896
  ENSP00000312506

SEQ ID NO: 26898 - protein, 401 aa, Homo sapiens
  ENSP00000392096
MPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 26899 - protein, 566 aa, Homo sapiens
  ENSP00000373244
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNVRKLCNTPRTSSPHARALAHYDNVICQDDPSAPHKIQEVLKSCLKEEESFNIQNSMSPKLEGGKGDQADLDVNCLQNNLT

SEQ ID NO: 26900 - protein, 539 aa, Homo sapiens
  ENSP00000264723
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 26901 - protein, 477 aa, Homo sapiens
  ENSP00000478923
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTKMILVLPTKSRRFSSPA

SEQ ID NO: 26902 - protein, 589 aa, Homo sapiens
  ENSP00000273153
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 26903 - protein, 589 aa, Homo sapiens; identical to SEQ ID NO: 26902
  ENSP00000422532

SEQ ID NO: 26904 - protein, 437 aa, Homo sapiens
  ENSP00000412081
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYY

SEQ ID NO: 26905 - protein, 138 aa, Homo sapiens
  ENSP00000386278
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMT

SEQ ID NO: 26906 - protein, 585 aa, Homo sapiens
  ENSP00000344042
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 26907 - protein, 617 aa, Homo sapiens
  ENSP00000387195
MKCALFLRVKILQRVCRSRYIVHAGTCDSTAAMSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 26908 - protein, 585 aa, Homo sapiens; identical to SEQ ID NO: 26906
  ENSP00000318258

SEQ ID NO: 26909 - protein, 193 aa, Homo sapiens
  ENSP00000356275
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 26910 - protein, 153 aa, Homo sapiens
  ENSP00000432110
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKDPKVRMLFDLLKHLVPCLMGGS

SEQ ID NO: 26911 - protein, 193 aa, Homo sapiens; identical to SEQ ID NO: 26909
  ENSP00000434147

SEQ ID NO: 26912 - protein, 17 aa, Homo sapiens
  ENSP00000483864
MPNWGGGKKSGALVHSE

SEQ ID NO: 26913 - protein, 193 aa, Homo sapiens; identical to SEQ ID NO: 26909
  ENSP00000436792

SEQ ID NO: 26914 - protein, 160 aa, Homo sapiens
  ENSP00000436491
MPNWGGGKKCGVCQKTVYFAEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALVHSE

SEQ ID NO: 26915 - protein, 153 aa, Homo sapiens
  ENSP00000437218
MVCKKNLDSTTVAVHGEEIYCKSCYGKKYGPKGYGYGQGAGTLSTDKGESLGIKHEEAPGHRPTTNPNASKFAQKIGGSERCPRCSQAVYAAEKVIGAGKSWHKACFRCAKCGKGLESTTLADKDGEIYCKGCYAKNFGPKGFGFGQGAGALV

SEQ ID NO: 26916 - protein, 193 aa, Homo sapiens; identical to SEQ ID NO: 26909
  ENSP00000345079

SEQ ID NO: 26917 - protein, 98 aa, Homo sapiens
  ENSP00000264474
MIPGGLSEAKPATPEIQEIVDKVKPQLEEKTNETYGKLEAVQYKTQVVAGTNYYIKVRAGDNKYMHLKVFKSLPGQNEDLVLTGYQVDKNKDDELTGF

SEQ ID NO: 26918 - protein, 63 aa, Homo sapiens
  ENSP00000418891
MIPGGLSEAKPATPEIQEIVDKVKPQLEEKTNETYGKLEAVQYKTQVVAGTNYYIKVRVQHLL

SEQ ID NO: 26919 - protein, 616 aa, Homo sapiens
  ENSP00000332444
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGPAAPIIDSPYGDPIDPEDAPESITRAVASLPPEQMFELMKQMKLCVQNSHQEARNMLLQNPQLAYALLQAQVVMRIMDPEIALKILHRKIHVTPLIPGKSQSVSVSGPGPGPGPGLCPGPNVLLNQQNPPAPQPQHLARRPVKDIPPLMQTPIQGGIPAPGPIPAAVPGAGPGSLTPGGAMQPQLGMPGVGPVPLERGQVQMSDPRAPIPRGPVTPGGLPPRGLLGDAPNDPRGGTLLSVTGEVEPRGYLGPPHQGPPMHHASGHDTRGPSSHEMRGGPLGDPRLLIGEPRGPMIDQRGLPMDGRGGRDSRAMETRAMETEVLETRVMERRGMETCAMETRGMEARGMDARGLEMRGPVPSSRGPMTGGIQGPGPINIGAGGPPQGPRQVPGISGVGNPGAGMQGTGIQGTGMQGAGIQGGGMQGAGIQGVSIQGGGIQGGGIQGASKQGGSQPSSFSPGQSQVTPQDQEKAALIMQVLQLTADQIAMLPPEQRQSILILKEQIQKSTGAS

SEQ ID NO: 26920 - protein, 405 aa, Homo sapiens
  ENSP00000359976
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 26921 - protein, 361 aa, Homo sapiens
  ENSP00000311554
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 26922 - protein, 373 aa, Homo sapiens
  ENSP00000413407
MQEKDASSQGFLPHFQHFATQAIHVGQDPEQWTSRAVVPPISLSTTFKQGAPGQHSGFEYSRSGNPTRNCLEKAVAALDGAKYCTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHS

SEQ ID NO: 26923 - protein, 895 aa, Homo sapiens
  ENSP00000389714
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVANLACSMSTNEDGIKIVKIAANHLETLCPQIINAALALAARPKSQAVKNTMEMYKRTWENHIHVLTEAVDDITSIDDFLAVSESHILEDVNKCIIALRDQDADNLDRAAGAIRGRAARVAHIVTGEMDSYEPGAYTEGVMRNVNFLTSTVIPEFVTQVNVALEALSKSSLNVLDDNQFVDISKKIYDTIHDIRCSVMMIRTPEELEDVSDLEEEHEVRSHTSIQTEGKTDRAKMTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 26924 - protein, 127 aa, Homo sapiens
  ENSP00000477144
  MOD_RES (1)..(1): Any amino acid
XISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVSMLEL

SEQ ID NO: 26925 - protein, 193 aa, Homo sapiens
  ENSP00000330570
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQ

SEQ ID NO: 26926 - protein, 184 aa, Homo sapiens
  ENSP00000441444
QDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNLCNQKSDLGLTGVKIKLLEECIIFWSL

SEQ ID NO: 26927 - protein, 333 aa, Homo sapiens [sequence omitted]

SEQ ID NO: 26928 - protein, 333 aa, Homo sapiens [sequence omitted]

SEQ ID NO: 26929 - protein, 225 aa, Homo sapiens
  ENSP00000340470
MNPTLILAAFCLGIASATLTFDHSLEAQWTKWKAMHNRLYGMNEEGWRRAVWEKNMKMIELHNQEYREGKHSFTMAMNAFGDMTSEEFRQVMNGFQNRKPRKGKVFQEPLFYEAPRSVDWREKGYVTPVKNQGQCGSCWAFSATGALEGQMFRKTGRLISLSEQNLVDCSGPQGNEGCNGGLMDYAFQYVQDNGGLDSEESYPYEATVSGAPCHHSSSAFGRWTL

SEQ ID NO: 26930 - protein, 331 aa, Homo sapiens
  ENSP00000357981
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 26931 - protein, 96 aa, Homo sapiens
  ENSP00000475176
  MOD_RES (1)..(1): Any amino acid
XVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 26932 - protein, 5 aa, Homo sapiens
  ENSP00000475557
  MOD_RES (1)..(1): Any amino acid
XYPEI

SEQ ID NO: 26933 - protein, 281 aa, Homo sapiens
  ENSP00000408414
MKRLVCVLLVCSSAVAQLHKDPTLDHHWHLWKKTYGKQYKEKNEEAVRRLIWEKNLKFVMLHNLEHSMGMHSYDLGMNHLGDMGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 26934 - protein, 117 aa, Homo sapiens
  ENSP00000475812
IIDNKGIDSDASYPYKAMDQKCQYDSKYRAATCSKYTELPYGREDVLKEAVANKGPVSVGVDARHPSFFLYRSDGVLLCCQAGVRWHDLSSLQPLPPGFKQFSCLSLLSSWDYRCLL

SEQ ID NO: 26935 - protein, 1663 aa, Homo sapiens
  ENSP00000160373
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQVGAWPAATPGLNQPACSDSSLVIPTTIAFCSSINPVSASSCRPGASDSLLVTASGWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 26936 - protein, 1151 aa, Homo sapiens
  ENSP00000389576
  MOD_RES (1)..(1): Any amino acid
XDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQKIQKVKCTREEPSCWSPSLTPLLMSGGPAPLAGRPTLLQQAAAQGNVTLLSMLLNEEGLDINYSCEDGHSALYSAAKNGHTDCVRLLLSAEAQVNAADKNGFTPLCAAAAQGHFECVELLISYDANINHAADGGQTPLYLACKNGNKECIKLLLEAGTNRSVKTTDGWTPVHAAVDTGNVDSLKLLMYHRIPAHGNSFNEEESESSVFDLDGGEESPEGISKPVVPADLINHANREGWTAAHIAASKGFKNCLEILCRHGGLEPERRDKCNRTVHDVATDDCKHLLENLNALKIPLRISVGEIEPSNYGSDDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLVEQYHNVIFHGPEGSLQDYIVHQLALCLKHRQMAAGFSCEIVRAEVDAGFSKEQLLDLFISSACLIPVKQSPSKKKIIIILENLEKSSLSELLRDFLAPLENRSTESPCTFQKGNGLSECYYFHENCFLMGTIAKACLQGSDLLVQQHFRWVQLRWDGEPMQGLLQRFLRRKVVNKFKGQAPSPCDPVCKIVDWALSVWRQLNSCLARLGTPEALLGPKYFLSCPVVPGHAQVTVKWMSKLWNGVIAPRVQEAILSRASVKRQPGFGQTTAKRHPSQGQQAVVKAALSILLNKAVLHGCPLPRAELDQHTADFKGGSFPLSIVSSYNTCNKKKGESGAWRKVNTSPRRKSGRFSLPTWNKPDLSTEGMKNKTISQLNCNRNASLSKQKSLENDLSLTLNLDQRLSLGSDDEADLVKELQSMCSSKSESDISKIADSRDDLRMFDSSGNNPVLSATINNLRMPVSQKEVSPLSSHQTTECSNSKSKTELGVSRVKSFLPVPRSKVTQCSQNTKRSSSSSNTRQIEINNNSKEVNWNLHKNEHLEKPNK

SEQ ID NO: 26937 - protein, 640 aa, Homo sapiens
  ENSP00000397678
MATDGASCEPDLSRAPEDAAGAAAEAAKKEFDVDTLSKSELRMLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEKKKTNELEEELSAEKRRSTEMEAQMEKQLSEFDTEREQLRAKLNREEAHTTDLKEEIDKMRKMIEQLKRGSDSKPSLSLPRKTKDRRLVSISVGTEGTVTRSVACQTDLVTENADHMKKLPLTMPVKPSTGSPLVSANAKGSVCTSATMARPGIDRQASYGDLIGASVPAFPPPSANKIEENGPSTGSTPDPTSSTPPLPSNAAPPTAQTPGIAPQNSQAPPMHSLHSPCANTSLHPGLNPRIQAARFRFQGNANDPDQNGNTTQSPPSRDVSPTSRDNLVAKQLARNTVTQALSRFTSPQAGAPSRPGVPPTGDVGTHPPVGRTSLKTHGVARVDRGNPPPIPPKKPGLSQTPSPPHPQLKVIIDSSRASNTGAKVDNKTVASTPSSLPQGNRVINEENLPKSSSPQLPPKPSIDLTVAPAGCAVSALATSQAGHPP

SEQ ID NO: 26938 - protein, 47 aa, Homo sapiens
  ENSP00000389491
  MOD_RES (1)..(1): Any amino acid
XSVWRQLNSCLARLGTPEALLGPKYFLSCPVVPGHAQVTVKARPAYS

SEQ ID NO: 26939 - protein, 193 aa, Homo sapiens
  ENSP00000395925
  MOD_RES (1)..(1): Any amino acid
XDLECENTICALNIRKQTSWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLHRQMAAGFSCEIVRAEVDAGFSKEQLLDLFISSACLIPVKQSPSKKKIIIILENLEKSSLSEL

SEQ ID NO: 26940 - protein, 120 aa, Homo sapiens
  ENSP00000406142
  MOD_RES (1)..(1): Any amino acid
XWDDFSKAVSQALTNHFQAISSDGWWSLEDVTCNNTTDSNIGLSARSIRSITLGNVPWSVGQSFAQSPWDFMRKNKAEHITVLLSGPQEGCLSSVTYASMIPLQMMQNYLRLMGKLNRER

SEQ ID NO: 26941 - protein, 161 aa, Homo sapiens
  ENSP00000396014
MLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKECKQLSGKVIEEAQKLEDVMAKLEEEK

SEQ ID NO: 26942 - protein, 136 aa, Homo sapiens
  ENSP00000405831
MLLSVMEGELEARDLVIEALRARRKEVFIQERYGRFNLNDPFLALQRDYEAGAGDKEKKPVCTNPLSILEAVMAHCKKMQERMSAQLAAAESRQKKLEMEKLQLQALEQEHKKLAARLEEERGKNKQVVLMLVKEC

SEQ ID NO: 26943 - protein, 95 aa, Homo sapiens
  ENSP00000393373
MLLSVMEGELEARDLVIEALRARRKEVFIQERYGRFNLNDPFLALQRDYEAGAGDKEKKPVCTNPLSILEAVMAHCKKMQERMSAQLAAAESRQK

SEQ ID NO: 26944 - protein, 82 aa, Homo sapiens
  ENSP00000313226
MSATWTLSPEPLPPSTGPPVGAGLDAEQRTVFAFVLCLLVVLVLLMVRCVRILLDPYSRMPASSWTDHKEALERGQFDYALV

SEQ ID NO: 26945 - protein, 81 aa, Homo sapiens
  ENSP00000368758
MDGGQPIPSSLVPLGNESADSSMSLEQKMTFVFVILLFIFLGILIVRCFRILLDPYRSMPTSTWADGLEGLEKGQFDHALA

SEQ ID NO: 26946 - protein, 81 aa, Homo sapiens; identical to SEQ ID NO: 26945
  ENSP00000378732

SEQ ID NO: 26947 - protein, 81 aa, Homo sapiens; identical to SEQ ID NO: 26945
  ENSP00000482081

SEQ ID NO: 26948 - protein, 1698 aa, Homo sapiens
  ENSP00000265348
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 26949 - protein, 1782 aa, Homo sapiens
  ENSP00000438788
MSRGFWLAEPLAGTGPHPAPVAADSRGCSSVPRRHAPSRLSVSTPSRGPGARMVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGEGQCGEEGKAGEGLGRLRDSQDTVAGASDLIRTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHQPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 26950 - protein, 397 aa, Homo sapiens
  ENSP00000006053
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 26951 - protein, 403 aa, Homo sapiens
  ENSP00000456830
MAPISLSWLLRLATFCHLTVLLAGTSLNSGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 26952 - protein, 55 aa, Homo sapiens
  ENSP00000457996
MAPISLSWLLRLATFCHLTVLLAAWRRDSTGCSVPTRRSNGSRTRCSIWTARLLP

SEQ ID NO: 26953 - protein, 359 aa, Homo sapiens
  ENSP00000464114
MTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 26954 - protein, 355 aa, Homo sapiens
  ENSP00000382166
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 26955 - protein, 166 aa, Homo sapiens
  ENSP00000394960
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFM

SEQ ID NO: 26956 - protein, 106 aa, Homo sapiens
  ENSP00000408835
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTT

SEQ ID NO: 26957 - protein, 355 aa, Homo sapiens; identical to SEQ ID NO: 26954
  ENSP00000439140

SEQ ID NO: 26958 - protein, 355 aa, Homo sapiens; identical to SEQ ID NO: 26954
  ENSP00000444928

SEQ ID NO: 26959 - protein, 387 aa, Homo sapiens
  ENSP00000351059
MREPLEAFKLADLDFRKSSLASGWRMASGAFTMDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 26960 - protein, 93 aa, Homo sapiens
  ENSP00000363551
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 26961 - protein, 103 aa, Homo sapiens
  ENSP00000379139
MNAKVVVVLVLVLTALCLSDGKPVSLSYRCPCRFFESHYCTCLIRVSFHGATPLTQGSWVLYSLSCAGGETGLREPGPMVSPRVESHQEGRLGVPGPVNLGKA

SEQ ID NO: 26962 - protein, 119 aa, Homo sapiens
  ENSP00000363548
MNAKVVVVLVLVLTALCLSDGKPVSLSYRCPCRFFESHVARANVKHLKILNTPNCALQIVARLKNNNRQVCIDPKLKWIQEYLEKALNKGRREEKVGKKEKIGKKKRQKKRKAAQKRKN

SEQ ID NO: 26963 - protein, 89 aa, Homo sapiens
  ENSP00000339913
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 26964 - protein, 140 aa, Homo sapiens
  ENSP00000379140
MNAKVVVVLVLVLTALCLSDGKPVSLSYRCPCRFFESHVARANVKHLKILNTPNCALQIVARLKNNNRQVCIDPKLKWIQEYLEKALNNLISAAPAGKRVIAGARALHPSPPRACPTARALCEIRLWPPPEWSWPSPGDV

SEQ ID NO: 26965 - protein, 103 aa, Homo sapiens; identical to SEQ ID NO: 26961
  ENSP00000379141

SEQ ID NO: 26966 - protein, 99 aa, Homo sapiens
  ENSP00000423783
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 26967 - protein, 111 aa, Homo sapiens
  ENSP00000337065
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 26968 - protein, 114 aa, Homo sapiens
  ENSP00000296027
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 26969 - protein, 356 aa, Homo sapiens
  ENSP00000386884
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 26970 - protein, 352 aa, Homo sapiens
  ENSP00000241393
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 26971 - protein, 433 aa, Homo sapiens
  ENSP00000381086
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDRDKLRLLYTLAVNSHPILLQIFPGAEGWPLPKYLGSCGRFLVSTSTRPLQEFYDAPPDQAADLAYQLLGVLESLRSNDLNYFFYFTHIDAGMFGVFNNGHLFIRDASAVGVIDKQEGSQEANRAGENKDIFSCLVSGCQAQLPSCESISEKQSLVLVCQKLLPRLLQGRFPSPVQDDIDSILVQCGDSIRPDPEVLGAASQLKDILRPLRTCDSRFAYRYPDCKYNDKF

SEQ ID NO: 26972 - protein, 182 aa, Homo sapiens
  ENSP00000367168
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 26973 - protein, 367 aa, Homo sapiens
  ENSP00000378248
MNTNVCVEPGPSPEAPGLPKESHLPEGALNSLVDYNSEMERYRSFATSFYKTNGGAFPQAAKIARITTPIFPSSAAAAAAAARIGMSPWNCDNAATAAAATAMLWGSGGGGGGGGGGGGGGGGGGGGGGGGGGGRKSSSAAASSSASSSSAILPAGGGGGGGGGGSRTSMHHRNDSQRLGKAGCPPEPSLQMANTNFLSTLSPEHCRPLAGECMNKLKCGAAEAEIMNLPERVGTFSAIPALGGISLPPGVIVMTALHSPAAASAAVTDSAFQIANLADCPQNHSSSSSSSSGGAGGANPAKKKRKRCGVCVPCKRLINCGVCSSCRNRKTGHQICKFRKCEELKKKPGTSLERTPVPSAEAFRWFF

SEQ ID NO: 26974 - protein, 134 aa, Homo sapiens
  ENSP00000341625
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 26975 - protein, 60 aa, Homo sapiens
  ENSP00000299438
MSKTFIIGELHPDDRPKLNKPPETLITTIDSSSSWWTNWVIPAISAVAVALMYRLYMAED

SEQ ID NO: 26976 - protein, 98 aa, Homo sapiens
  ENSP00000436461
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 26977 - protein, 124 aa, Homo sapiens
  ENSP00000381011
MAEQSDEAVKYYTLEEIQKHNHSKSTWLILHHKVYDLTKFLEEHPGGEEVLREQAGGDATENFEDVGHSTDAREMSKTFIIGELHPETLITTIDSSSSWWTNWVIPAISAVAVALMYRLYMAED

SEQ ID NO: 26978 - protein, 105 aa, Homo sapiens
  ENSP00000307786
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 26979 - protein, 105 aa, Homo sapiens; identical to SEQ ID NO: 26978
  ENSP00000386270

SEQ ID NO: 26980 - protein, 105 aa, Homo sapiens; identical to SEQ ID NO: 26978
  ENSP00000387279

SEQ ID NO: 26981 - protein, 101 aa, Homo sapiens
  ENSP00000416479
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKK

SEQ ID NO: 26982 - protein, 1278 aa, Homo sapiens
  ENSP00000479719
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQACQWSPRALFHPTGGTQGRRGCRSLLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 26983 - protein, 1253 aa, Homo sapiens
  ENSP00000479968
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 26984 - protein, 1057 aa, Homo sapiens
  ENSP00000428009
MTTHVTLEDALSNVDLLEELPLPDQQPCIEPPPSSIMYQANFDTNFEDRNAFVTGIARYIEQATVHSSMVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 26985 - protein, 1117 aa, Homo sapiens
  ENSP00000403793
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 26986 - protein, 68 aa, Homo sapiens
  ENSP00000428079
MTTHVTLEDALSNVDLLEELPLPDQQPCIEPPPSSIMYQANFDTNFEDRNAFVTGIASARPSSGSAAR

SEQ ID NO: 26987 - protein, 1227 aa, Homo sapiens
  ENSP00000430904
MTTHVTLEDALSNVDLLEELPLPDQQPCIEPPPSSIMYQANFDTNFEDRNAFVTGIARYIEQATVHSSMVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 26988 - protein, 295 aa, Homo sapiens
  ENSP00000480605
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQQLEVIPGYEELLADIVNICVDYYENKMYLTPSEKHMLLKVMGFGLYLMDGNVSNIYKLDAKKRINLSKIDKFF

SEQ ID NO: 26989 - protein, 188 aa, Homo sapiens
  ENSP00000479376
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAY

SEQ ID NO: 26990 - protein, 222 aa, Homo sapiens
  ENSP00000478058
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQ

SEQ ID NO: 26991 - protein, 1253 aa, Homo sapiens; identical to SEQ ID NO: 26983
  ENSP00000484819

SEQ ID NO: 26992 - protein, 71 aa, Homo sapiens
  ENSP00000479211
MTTHVTLEDALSNVDLLEELPLPDQQPCIEPPPSSIMYQANFDTNFEDRNAFVTGIARYIEQATVHSSMIF

SEQ ID NO: 26993 - protein, 101 aa, Homo sapiens
  ENSP00000482739
LYMVRTMLESLIADKSGSKKTLRSSLDGPIVLAIEDFHKQSFFFTHLLNISDGVLLCCPGWSAVALSQLTATSASQVQAGVQSCDLSSPQPLPPRSPAAVL

SEQ ID NO: 26994 - protein, 190 aa, Homo sapiens
  ENSP00000293230
MEKVPGEMEIERRERSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 26995 - protein, 226 aa, Homo sapiens
  ENSP00000466448
MEKVPGEMEIERRERSEELSEAERKAVQAMWARLYANCEDVGVAILVRFFVNFPSAKQYFSQFKHMEDPLEMERSPQLRKHACRVMGALNTVVENLHDPDKVSSVLALVGKAHALKHKVEPVYFKPTGHTALFGAVGPLTPPPSLAAPRAEGRVLKTLLDAPFLGAKEAGGIPDSTSPKEASVAARVPPWSCWEAALAAWMLTPARRAERGPLFLAFLLTVRERPS

SEQ ID NO: 26996 - protein, 125 aa, Homo sapiens
  ENSP00000464817
MEDPLEMERSPQLRKHACRVMGALNTVVENLHDPDKVSSVLALVGKAHALKHKVEPVYFKILSGVILEVVAEEFASDFPPETQRAWAKLRGLIYSHVTAAYKEVGWVQQVPNATTPPATLPSSGP

SEQ ID NO: 26997 - protein, 125 aa, Homo sapiens; identical to SEQ ID NO: 26996
  ENSP00000468559

SEQ ID NO: 26998 - protein, 531 aa, Homo sapiens
  ENSP00000258415
MAALGCARLRWALRGAGRGLCPHGARAKAAIPAALPSDKATGAPGAGPGVRRRQRSLEEIPRLGQLRFFFQLFVQGYALQLHQLQVLYKAKYGPMWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLLASGQLSPREAMGSLPELLMAGVDTTSNTLTWALYHLSKDPEIQEALHEEVVGVVPAGQVPQHKDFAHMPLLKAVLKETLRLYPVVPTNSRIIEKEIEVDGFLFPKNTQFVFCHYVVSRDPTAFSEPESFQPHRWLRNSQPATPRIQHPFGSVPFGYGVRACLGRRIAELEMQLLLARLIQKYKVVLAPETGELKSVARIVLVPNKKVGLQFLQRQC

SEQ ID NO: 26999 - protein, 115 aa, Homo sapiens
  ENSP00000404945
MAALGCARLRWALRGAGRGLCPHGARAKAAIPAALPSDKATGAPGAGPGVRRRQRSLEEIPRLGQLRFFFQLFVQGYALQLHQLQGRTPLVPAAPGSEPAVAEASGSSALYGCFQ

SEQ ID NO: 27000 - protein, 221 aa, Homo sapiens
  ENSP00000392671
MWMSYLGPQMHVNLASAPLLEQVMRQEGKYPVRNDMELWKEHRDQHDLTYGPFTTEGHHWYQLRQALNQRLLKPAEAALYTDAFNEVIDDFMTRLDQLRAESASGNQVSDMAQLFYYFALEAICYILFEKRIGCLQRSIPEDTVTFVRSIGLMFQNSLYATFLPKWTRPVLPFWKRYLDGWNAIFSFGKKLIDEKLEDMEAQLQAAGPDGIQVSGYLHFLL

SEQ ID NO: 27001 - protein, 180 aa, Homo sapiens
  ENSP00000353241
LRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKWWLTCSLPGW

SEQ ID NO: 27002 - protein, 497 aa, Homo sapiens [sequence omitted]

SEQ ID NO: 27003 - protein, 446 aa, Homo sapiens
  ENSP00000351927
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVSPSPYELCAVPR

SEQ ID NO: 27004 - protein, 494 aa, Homo sapiens [sequence omitted]

SEQ ID NO: 27005 - protein, 180 aa, Homo sapiens; identical to SEQ ID NO: 27001
  ENSP00000487214

SEQ ID NO: 27006 - protein, 497 aa, Homo sapiens
  ENSP00000479867
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27007 - protein, 446 aa, Homo sapiens
  ENSP00000483677
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27008 - protein, 497 aa, Homo sapiens
  ENSP00000476021
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27009 - protein, 446 aa, Homo sapiens
  ENSP00000483245
MGLEALVPLAVIVAIFLLLVDLMHRRQRWAARYSPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27010 - protein, 180 aa, Homo sapiens; identical to SEQ ID NO: 27001
  ENSP00000487281

SEQ ID NO: 27011 - protein, 497 aa, Homo sapiens; identical to SEQ ID NO: 27008
  ENSP00000486094

SEQ ID NO: 27012 - protein, 494 aa, Homo sapiens
  ENSP00000487558
MHRRQRWAARYSPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQQGGRVQAGAHPIVGTHVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27013 - protein, 446 aa, Homo sapiens; identical to SEQ ID NO: 27009
  ENSP00000486619

SEQ ID NO: 27014 - protein, 180 aa, Homo sapiens; identical to SEQ ID NO: 27001
  ENSP00000488991

SEQ ID NO: 27015 - protein, 497 aa, Homo sapiens; identical to SEQ ID NO: 27008
  ENSP00000489231

SEQ ID NO: 27016 - protein, 446 aa, Homo sapiens; identical to SEQ ID NO: 27009
  ENSP00000489103

SEQ ID NO: 27017 - protein, 494 aa, Homo sapiens; identical to SEQ ID NO: 27012
  ENSP00000489144

SEQ ID NO: 27018 - protein, 180 aa, Homo sapiens
  ENSP00000490065
LRRRFGDVFSLQLAWTPVVVLNGLAAVREAMVTRGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKWWLTCSLPGW

SEQ ID NO: 27019 - protein, 497 aa, Homo sapiens [sequence omitted]

SEQ ID NO: 27020 - protein, 494 aa, Homo sapiens
  ENSP00000489990
MHRRQRWAARYSPGPLPLPGLGNLLHVDFQNTPYCFDQLRRRFGDVFSLQLAWTPVVVLNGLAAVREAMVTRGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQQGGRVQAGAHPIVGTHVCPGRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27021 - protein, 446 aa, Homo sapiens
  ENSP00000490398
MGLEALVPLAVIVAIFLLLVDLMHRRQRWAARYSPGPLPLPGLGNLLHVDFQNTPYCFDQLRRRFGDVFSLQLAWTPVVVLNGLAAVREAMVTRGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLRIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 27022 - protein, 502 aa, Homo sapiens
  ENSP00000360247
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 27023 - protein, 506 aa, Homo sapiens
  ENSP00000310721
MAGEVSAATGRFSLERLGLPGLALAAALLLLALCLLVRRTRRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 27024 - protein, 381 aa, Homo sapiens [sequence omitted]

SEQ ID NO: 27025 - protein, 97 aa, Homo sapiens
  ENSP00000261811
MNQENPPPYPGPGPTAPYPPYPPQPMGPGPMGGPYPPPQGYPYQGYPQYGWQGGPQEPPKTTVYVVEDQRRDELGPSTCLTACWTALCCCCLWDMLT

SEQ ID NO: 27026 - protein, 154 aa, Homo sapiens
  ENSP00000299340
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 27027 - protein, 132 aa, Homo sapiens
  ENSP00000382918
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPEYELHEAEILVYFVQHSIPSM

SEQ ID NO: 27028 - protein, 297 aa, Homo sapiens
  ENSP00000284881
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 27029 - protein, 296 aa, Homo sapiens
  ENSP00000383404
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQVFEELTHQVQEKDSLASQLHVRHVAIEQLLKNCSKLPCLQVGRTGMKSHLPINN

SEQ ID NO: 27030 - protein, 221 aa, Homo sapiens
  ENSP00000383403
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREE

SEQ ID NO: 27031 - protein, 242 aa, Homo sapiens
  ENSP00000385566
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQ

SEQ ID NO: 27032 - protein, 836 aa, Homo sapiens
  ENSP00000433481
  MOD_RES (1)..(1): Any amino acid
XPSKDSTESLVQPGPKGGQEAADVSADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEK

SEQ ID NO: 27033 - protein, 1849 aa, Homo sapiens
  ENSP00000315295
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 27034 - protein, 1235 aa, Homo sapiens
  ENSP00000265654
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTGAATNAADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKQVAQ

SEQ ID NO: 27035 - protein, 836 aa, Homo sapiens; identical to SEQ ID NO: 27032
  ENSP00000433481
  MOD_RES (1)..(1): Any amino acid

SEQ ID NO: 27036 - protein, 1849 aa, Homo sapiens; identical to SEQ ID NO: 27033
  ENSP00000315295

SEQ ID NO: 27037 - protein, 1235 aa, Homo sapiens; identical to SEQ ID NO: 27034
  ENSP00000265654

SEQ ID NO: 27038 - protein, 1618 aa, Homo sapiens
  ENSP00000261588
MDGQTLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQELRRSLELSVNLQRKQKDCSSDEYDSIEEDILSEPEPEDPALVGHPRHDRPPSSGDWTQKDVHGEQETEGRSSPGPDTLVVLEFNPASKSHKRERNLSAKRKDNAEVFVPTKPEPNLTPQAPAVFPDQERMCSRPGSRRERPLSATRKTLCEAEYPEEDASAVLQAIQVENAALQRALLSRKAEQPASPLQDAEGPPAKPWTSLLEEKEETLELLPITTATTTQEPAGAAGGARAINQAMDRIGLLGSRQQQKLLKVLQAVESDSAHLGRVVSPTKEQVSDTEDKQRMRADEIKDAIYVTMEILSNWGNSWWVGLTEVEFFDLNDTKLYVSPHDVDIRNTATPGELGRLVNRNLAGKKDSSPWTCPFHPPLQLFFVIRNTRQLGDFHLAKIKVRNYWTADGDLDIGAKNVKLYVNRNLIFNGKLDKGDREAPADHSILVDQKNEKSEQLEEAMNAHSEESKGTHEMAGASGDKELGLGCSPPAETLADAKLSSQGNVSGKRKNSTNCRKDSLSQLEEYLRLSAVPTSMGDMPSAPATSPPVKCPPVHEEPSLIQQLENLMGRKICEPPGKTPSWLQPSPTGKDRKQGGRKPKPLWLSPEKPLAWKGRLPSDDVIGEGPGETEARDKGLRHEPGWGTSRSVNTKERPQRATTKVHSDDSDIFNQPPNRERPASGRRGSRKDAGSSSHGDDQPASREDTWSSRTPSRSRWRSEQEHTLHESWSSLSAFDRSHRGRISNTELPGDILDELLQQKSSRHSDLPPSKKGEQPGLSRGQDGYSGETDAGGDFKIPVLPYGQRLVIDIKSTWGDRHYVGLNGIEIFSSKGEPVQISNIKADPPDINILPAYGKDPRVVTNLIDGVNRTQDDMHVWLAPFTRGRSHSITIDFTHPCHVALIRIWNYNKSRIHSFRGVKDITMLLDTQCIFEGEIAKASGTLAGAPEHFGDTILFTTDDDILEAIFYSDEMFDLDVGSLDSLQDEEAMRRPSTADGEGDERPFTQAGLGADERIPELELPSSSPVPQVTTPEPGIYHGICLQLNFTASWGDLHYLGLTGLEVVGKEGQALPIHLHQISASPRDLNELPEYSDDSRALDKLIDGTNITMEDEHMWLIPFSPGLDHVVTIRLDRAESIAGLRFWNYNKSPEDTYRGAKIVHVSLDGLCVSPPEGFLIRKGPGNCHFDFAQEILFVDYLRAQLLPQPARRLDMRSLECASMDYEAPLMPCGFIFQFQLLTSWGDPYYIGLTGLELYDERGEKIPLSENNIAAFPDSVNSLEGVGGDVRTPDKLIDQVNDTSDGRHMWLAPILPGLVNRVYVIFDLPTTVSMIKLWNYAKTPHRGVKEFGLLVDDLLVYNGILAMVSHLVGGILPTCEPTVPYHTILFTEDRDIRHQEKHTTISNQAEDQDVQMMNENQIITNAKRKQSVVDPALRPKTCISEKETRRRRC

SEQ ID NO: 27039 - protein, 249 aa, Homo sapiens
  ENSP00000454884
  MOD_RES (1)..(1): Any amino acid
XLRKAERSWSCSREKKEGYAKDMVTDFDEKHDEYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQKSVQIRTEAGPRLHIEPPVDYSDDFELCGDVTLQANNTSEDRPQDTKSPTSTKPCGFNFSLLNACGHSDPSSSVDKERILLTIQDVMELRRSLELSVNLQRKQKDCSSDEYDSIEED

SEQ ID NO: 27040 - protein, 55 aa, Homo sapiens
  ENSP00000455380
  MOD_RES (1)..(1): Any amino acid
XRSWSCSREKKEDIKAFEKQGPRAIEAGALGARFLCLCQRCQFGAEIITAESYSL

SEQ ID NO: 27041 - protein, 110 aa, Homo sapiens
  ENSP00000483214
EYLILLQQRNRILKHLKSKDPVQLRLEHLEQGFSVYVNGANSELKSSPRKAIHSDFSRSASHTEGTHDYGRRTLFREAEEALRRSSRTAPSKVQRRGWHQVWRLWPQPTL

SEQ ID NO: 27042 - protein, 139 aa, Homo sapiens
  ENSP00000389385
RPIYPNRREREAMILSSYAGILMNSIPIEEVFKIYGADSSADSGTIKVPRVSSLCLSLHPFAMLTAPKAAAYARKQIETGFHRGLDLLTSRSARLGLPKRWDYRLEPPRPAQLLGHLENWNCTMELHNRFSGSRREASS

SEQ ID NO: 27043 - protein, 193 aa, Homo sapiens
  ENSP00000343171
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 27044 - protein, 174 aa, Homo sapiens
  ENSP00000405393
MRGCFSMPPEAEKEQKHWNRSPAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 27045 - protein, 128 aa, Homo sapiens
  ENSP00000408378
  MOD_RES (1)..(1): Any amino acid
XVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSHLENWNCTMELHNRFSGSRREASS

SEQ ID NO: 27046 - protein, 124 aa, Homo sapiens
  ENSP00000397144
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVT

SEQ ID NO: 27047 - protein, 83 aa, Homo sapiens
  ENSP00000413016
MILSSYAGILMNSIPIEEVFKIYGADSSADSGTIKVPRVSSLCLSLHPFAMLTAPKAAAYARKQSVKSRKVTTNKNATSISAK

SEQ ID NO: 27048 - protein, 66 aa, Homo sapiens
  ENSP00000397281
MERRLIKKEMKKLLGDYIGIRLRENEFDPKGRRQLTFLDDMAHYDLAISVALQWLDPSEDLTWLEW

SEQ ID NO: 27049 - protein, 242 aa, Homo sapiens
  ENSP00000411609
  MOD_RES (1)..(1): Any amino acid
XWSGSFPLENTELANVGANQVTVRKGEKDHTTHCHASDHANQLSIHIPGWSYRAGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 27050 - protein, 103 aa, Homo sapiens
  ENSP00000474753
MVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 27051 - protein, 660 aa, Homo sapiens
  ENSP00000349318
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKVMASSPAGVMCVVHRCRIST

SEQ ID NO: 27052 - protein, 662 aa, Homo sapiens
  ENSP00000405995
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEV

SEQ ID NO: 27053 - protein, 209 aa, Homo sapiens
  ENSP00000474558
MISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRV

SEQ ID NO: 27054 - protein, 39 aa, Homo sapiens
  ENSP00000474615
MLKLSGEGLRDSYHSRRDQIALKNLQSDVTEAKSDFTKV

SEQ ID NO: 27055 - protein, 699 aa, Homo sapiens
  ENSP00000284694
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKRIYDNLPEVKKKKEEQRKRVILQSNRLRAEVFKKQLLDQLLQRNAV

SEQ ID NO: 27056 - protein, 1609 aa, Homo sapiens
  ENSP00000386574
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 27057 - protein, 71 aa, Homo sapiens
  ENSP00000413054
MAGLRRPQPGCYCRTAAAVNLLLGVFQVLLPCCRPGGAQGQAIEPLPNVVELWQAEEGELLLPTQLLGQTI

SEQ ID NO: 27058 - protein, 1610 aa, Homo sapiens
  ENSP00000386787
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 27059 - protein, 1387 aa, Homo sapiens
  ENSP00000240487
PVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 27060 - protein, 555 aa, Homo sapiens
  ENSP00000360280
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 27061 - protein, 588 aa, Homo sapiens
  ENSP00000360275
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 27062 - protein, 239 aa, Homo sapiens
  ENSP00000360276
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGA

SEQ ID NO: 27063 - protein, 204 aa, Homo sapiens
  ENSP00000329120
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQP

SEQ ID NO: 27064 - protein, 213 aa, Homo sapiens
  ENSP00000360274
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQVISETSRGFRFKSD

SEQ ID NO: 27065 - protein, 555 aa, Homo sapiens; identical to SEQ ID NO: 27060
  ENSP00000387581

SEQ ID NO: 27066 - protein, 553 aa, Homo sapiens
  ENSP00000395296
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVPTSQKKEGVYDVPKSQPVSNGYSFEDFEERFAAATPNRNLPTDFDEIFEATKAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 27067 - protein, 706 aa, Homo sapiens
  ENSP00000482245
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 27068 - protein, 758 aa, Homo sapiens
  ENSP00000482797
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 27069 - protein, 558 aa, Homo sapiens
  ENSP00000482493
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 27070 - protein, 504 aa, Homo sapiens
  ENSP00000481551
MAVPAALIPPTQLVPPQPPISTSASSSGTTTSTSSATSSPAPSIGPPASSGPTLFRPEPIASAAAAAATVTSTGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 27071 - protein, 280 aa, Homo sapiens
  ENSP00000355761
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTELCNAPGELDMHAPPAGCTSSSLTGVGSGLRGKCGLCGCQLPFCSVNTSSKTKSSGISRQQ

SEQ ID NO: 27072 - protein, 774 aa, Homo sapiens
  ENSP00000355760
MWTPGGPPGSAGWDRRRLGARLRAAFAGLQELQGLRATQQERVRGALALQPPPAPAAPCGPHGLHGPEQQLEAALAALQEQLSRLRQQDIGLKTHLDQLDLQISKLQLDVGTASGEALDSDSRPSSGFYEMSDGGSCSLSTSCASVCSDHISPSLGSLLPVAQAHKARPSMGDWRPRSVDETTVPAWRPQATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQRQGGWSTDGGGRLLVFAPGREDEGGPAQSRGAGRGGPQQQGYMPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 27073 - protein, 604 aa, Homo sapiens
  ENSP00000476573
MGDWRPRSVDETTVPAWRPQATEEGARPPGSVEDAGQPWGTFWPRPVSTGDLDRALPADTGLQKASADAELLGLLCQGVDIPLHVPDPKYRQDLVSQGGREVYPYPSPLHAVALQSPLFVLTKETPQRGGPSFPRESPRGPAGLNTIQTGPVLEAGPARARAYIDRLLHLWGRETPAKGSEGEQGPLRHAASPSPQRQGGWSTDGGGRLLVFAPGREDEGGPAQSRGAGRGGPQQQGYMPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 27074 - protein, 366 aa, Homo sapiens
  ENSP00000476434
MPLEGPQQSGSLPEEGSKPSNSCVLRETMVQASPSSKAQQTPSAQDYGRGNIISPSRMLDKSPSPASGHFAHPSFAASLKMGPPKSKAEKIKRSPMDKVLRFARQPLLLLDRPEGAHAAPQPSLEWDPAHWPTGRGGLQRRPALAWEAPGRSCSESTLYPMPVLVPLAVAPQESHRTSAQALFPFEASLLTSVARRKHRRWQSTVEISARARLASCPESNLGPPRPVARRAGGPLARGRPSLVRQDAYTRSDSEPSKHSAECDPRFPSVIPETSEGESSDHTTNRFGDRESSSSDEEGGAQSRDCDLALGYVAAGHAELAWTQEAPVSSGPLLSPVPKLCRIKASKALKKKIRRFQPTALKVMTMV

SEQ ID NO: 27075 - protein, 1042 aa, Homo sapiens
  ENSP00000257215
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMQYVLYVRLAILVIEFIYAIVGIVWLTQYYTSCNDLTAKNVTLGMVVCNWVVILSVCITVLCVFDPTGRTFVKLRATKRRQRNLRTYNLRHRLEEGQATSWSRRLKVFLCCTRTKDSQSDAYSEIAYLFAEFFRDLDIVPSDIIAGLVLLRQRQRAKRNAVLDEANNDILAFLSGMPVTRNTKYLDLKNSQEMLRYKEVCYYMLFALAAYGWPMYLMRKPACGLCQLARSCSCCLCPARPRFAPGVTIEEDNCCGCNAIAIRRHFLDENMTAVDIVYTSCHDAVYETPFYVAVDHDKKKVVISIRGTLSPKDALTDLTGDAERLPVEGHHGTWLGHKGMVLSAEYIKKKLEQEMVLSQAFGRDLGRGTKHYGLIVVGHSLGAGTAAILSFLLRPQYPTLKCFAYSPPGGLLSEDAMEYSKEFVTAVVLGKDLVPRIGLSQLEGFRRQLLDVLQRSTKPKWRIIVGATKCIPKSELPEEVEVTTLASTRLWTHPSDLTIALSASTPLYPPGRIIHVVHNHPAEQCCCCEQEEPTYFAIWGDNKAFNEVIISPAMLHEHLPYVVMEGLNKVLENYNKGKTALLSAAKVMVSPTEVDLTPELIFQQQPLPTGPPMPTGLALELPTADHRNSSVRSKSQSEMSLEGFSEGRLLSPVVAAAARQDPVELLLLSTQERLAAELQARRAPLATMESLSDTESLYSFDSRRSSGFRSIRGSPSLHAVLERDEGHLFYIDPAIPEENPSLSSRTELLAADSLSKHSQDTQPLEAALGSGGVTPERPPSAAANDEEEEVGGGGGGPASRGELALHNGRLGDSPSPQVLEFAEFIDSLFNLDSKSSSFQDLYCMVVPESPTSDYAEGPKSPSQQEILLRAQFEPNLVPKPPRLFAGSADPSSGISLSPSFPLSSSGELMDLTPTGLSSQECLAADKIRTSTPTGHGASPAKQDELVISAR

SEQ ID NO: 27076 - protein, 167 aa, Homo sapiens
  ENSP00000440264
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMHHPGDRVHLRHRGHRLAHSVLHLLQRPHCQECHPRNGCLQLGSHPQCVHHCPLRLRPHGPHLCQAESHQEEAA

SEQ ID NO: 27077 - protein, 281 aa, Homo sapiens
  ENSP00000446853
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 27078 - protein, 347 aa, Homo sapiens
  ENSP00000228476
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 27079 - protein, 78 aa, Homo sapiens
  ENSP00000448095
MRVVVIGAGVIGLSTALCIHERYHSVLQPLDIKVYADRFTPLTTTDVAAGLWQPYLSDPNNPQEATLPGRTQFWDFGS

SEQ ID NO: 27080 - protein, 166 aa, Homo sapiens
  ENSP00000449967
MFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQI

SEQ ID NO: 27081 - protein, 123 aa, Homo sapiens
  ENSP00000449248
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPLWLVPHKPNSGGKELSTVAD

SEQ ID NO: 27082 - protein, 196 aa, Homo sapiens
  ENSP00000447104
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQ

SEQ ID NO: 27083 - protein, 1430 aa, Homo sapiens
  ENSP00000350785
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 27084 - protein, 1430 aa, Homo sapiens; identical to SEQ ID NO: 27083
  ENSP00000417076

SEQ ID NO: 27085 - protein, 1430 aa, Homo sapiens; identical to SEQ ID NO: 27083
  ENSP00000386135

SEQ ID NO: 27086 - protein, 1364 aa, Homo sapiens
  ENSP00000419026
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 27087 - protein, 188 aa, Homo sapiens
  ENSP00000417746
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVGVSG

SEQ ID NO: 27088 - protein, 1430 aa, Homo sapiens; identical to SEQ ID NO: 27083
  ENSP00000484267

SEQ ID NO: 27089 - protein, 1364 aa, Homo sapiens; identical to SEQ ID NO: 27086
  ENSP00000418885

SEQ ID NO: 27090 - protein, 91 aa, Homo sapiens
  ENSP00000453639
MFQASMRSPNMEPFKQQKVEDFYDIGEELGSGQFAIVKKCREKSTGLEYAAKFIKKRQSRASRRGVSREEIERESVWRRALRFPGPEGVTE

SEQ ID NO: 27091 - protein, 370 aa, Homo sapiens
  ENSP00000408277
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 27092 - protein, 48 aa, Homo sapiens
  ENSP00000453101
MKKVHLRPDEDLTEFHSYCLGWSAMARSRLTATSASWLQAILLRQPPE

SEQ ID NO: 27093 - protein, 488 aa, Homo sapiens
  ENSP00000484390
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITSKGEGRAPEQRKTEPTQLKTKHLREYTLKCHSSMPPNNSYVNFERFACVVEDVARVDLGCRALVEAHDTIQDDVEALVSIFNEKEAWYREENESARHDLSQLRYEFRKVESLKKLLREDIQATGCSLGSMARKLDHLQAQFEILRQELSADLQWIQELVGSFQLESGSSEGLGSTFYQDTSESLSELLSRSCTEEFLAGWKL

SEQ ID NO: 27094 - protein, 88 aa, Homo sapiens
  ENSP00000453284
MFQASMRSPNMEPFKQQKVEDFYDIGEELGRFLAGILLFQTLHLLLTLLLLPACFSLLSCPSSSQRTAHLALWPVCHREEVPGEEHGA

SEQ ID NO: 27095 - protein, 80 aa, Homo sapiens
  ENSP00000452970
MFQASMRSPNMEPFKQQKVEDFYDIGEELGSGQFAIVKKCREKSTGLEYAAKFIKKRQSRASRRGVSREEIEREVSILRQ

SEQ ID NO: 27096 - protein, 370 aa, Homo sapiens; identical to SEQ ID NO: 27091
  ENSP00000261891

SEQ ID NO: 27097 - protein, 488 aa, Homo sapiens; identical to SEQ ID NO: 27093
  ENSP00000453235

SEQ ID NO: 27098 - protein, 620 aa, Homo sapiens
  ENSP00000270349
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 27099 - protein, 620 aa, Homo sapiens; identical to SEQ ID NO: 27098
  ENSP00000479597

SEQ ID NO: 27100 - protein, 617 aa, Homo sapiens
  ENSP00000376776
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 27101 - protein, 244 aa, Homo sapiens
  ENSP00000263611
MREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAK

SEQ ID NO: 27102 - protein, 539 aa, Homo sapiens
  ENSP00000296955
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMAG

SEQ ID NO: 27103 - protein, 715 aa, Homo sapiens
  ENSP00000342422
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 27104 - protein, 99 aa, Homo sapiens
  ENSP00000391700
NNHKPREWLEIDLGEKKKITGIRTTGSTQSNFNFYVKSFVMNFKNNNSKWKTYKGIVNNEEKVMIHWCGARQVKAPVFQLRKKMRQSQGPSPRKKHPQE

SEQ ID NO: 27105 - protein, 1447 aa, Homo sapiens
  ENSP00000389140
MENSLRCVWVPKLAFVLFGASLFSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 27106 - protein, 181 aa, Homo sapiens
  ENSP00000463699
  MOD_RES (1)..(1): Any amino acid
XIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGANIRILPRRSTSSCAAVWKMYPRALEYAQNSIWEGLVTVQSFPFYIYRDIVYFQMISRKLNCSDSVILNDLMIFI

SEQ ID NO: 27107 - protein, 88 aa, Homo sapiens
  ENSP00000463131
RGVPVIKWKKDGIHLALGMDERKQQLSNGSLLIQNILHSRHHKPDEGLYQCEASLGDSGSIISRTAKVAVAEGNVRLRKFGQHSHGSL

SEQ ID NO: 27108 - protein, 772 aa, Homo sapiens
  ENSP00000304146
  MOD_RES (1)..(1): Any amino acid
XGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITVRRHNISKLHSNRPQTKHNV

SEQ ID NO: 27109 - protein, 74 aa, Homo sapiens
  ENSP00000464277
  MOD_RES (1)..(1): Any amino acid
XVPVIKWKKDGIHLALGMDERKQQLSNGSLLIQNILHSRHHKPDEGLYQCEASLGDSGSIISRTAKVAVAGLCS

SEQ ID NO: 27110 - protein, 70 aa, Homo sapiens
  ENSP00000463463
VPVIKWKKDGIHLALGMDERKQQLSNGSLLIQNILHSRHHKPDEGLYQCEASLGDSGSIISRTAKVAVAD

SEQ ID NO: 27111 - protein, 1076 aa, Homo sapiens
  ENSP00000464582
MDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRTVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVEMEWVKQYAISYYPLLLPASSFSV

SEQ ID NO: 27112 - protein, 102 aa, Homo sapiens
  ENSP00000463766
MDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRL

SEQ ID NO: 27113 - protein, 208 aa, Homo sapiens
  ENSP00000464292
  MOD_RES (1)..(1): Any amino acid
XSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQDTGVTINLVNEVLLG

SEQ ID NO: 27114 - protein, 1424 aa, Homo sapiens
  ENSP00000397322
SLCSLVPGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 27115 - protein, 740 aa, Homo sapiens
  ENSP00000353846
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 27116 - protein, 433 aa, Homo sapiens
  ENSP00000369223
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 27117 - protein, 729 aa, Homo sapiens
  ENSP00000255448
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 27118 - protein, 363 aa, Homo sapiens
  ENSP00000369222
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRDLYRPLSSDDLDSVGDSV

SEQ ID NO: 27119 - protein, 422 aa, Homo sapiens
  ENSP00000484452
MLELIEVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIALDHGFTIKRSGSLDYYQQPGMYWIRPPLLIRRGRFSDEDATRM

SEQ ID NO: 27120 - protein, 304 aa, Homo sapiens
  ENSP00000319482
MGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRKEFFDGCKAISADSIDGICARFPSLLTEAKQEDKFKDLYRFTFQFGLDSEEGQRSLHREIAIALWKLVFTQNNPPVLDQWLNFLTENPSGIKGISRDTWNMFLNFTQVIGPDLSNYSEDEAWPSLFDTFVEWEMERRKREGEGRGALSSGPEGLCPEEQT

SEQ ID NO: 27121 - protein, 304 aa, Homo sapiens; identical to SEQ ID NO: 27120
  ENSP00000454762

SEQ ID NO: 27122 - protein, 365 aa, Homo sapiens
  ENSP00000489635
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKDLYLPLSLDDSDSLGDSM

SEQ ID NO: 27123 - protein, 366 aa, Homo sapiens
  ENSP00000490614
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSGNDQDANGTSSSQLSTPKSKQSPISTPTSPGSLRKHKVDLYLPLSLDDSDSLGDSM

SEQ ID NO: 27124 - protein, 360 aa, Homo sapiens
  ENSP00000350776
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKDLYLPLSLDDSDSLGDSM

SEQ ID NO: 27125 - protein, 361 aa, Homo sapiens
  ENSP00000490878
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYTKNVNPNWSVNVKTSANMKAPQSLASSNSAQARENKDFVRPKLVTIIRSGVKPRKAVRVLLNKKTAHSFEQVLTDITEAIKLETGVVKKLYTLDGKQVTCLHDFFGDDDVFIACGPEKFRYAQDDFSLDENECRVMKGNPSATAGPKASPTPQKTSAKSPGPMRRSKSPADSANGTSSSQLSTPKSKQSPISTPTSPGSLRKHKVDLYLPLSLDDSDSLGDSM

SEQ ID NO: 27126 - protein, 366 aa, Homo sapiens; identical to SEQ ID NO: 27123
  ENSP00000348553

SEQ ID NO: 27127 - protein, 360 aa, Homo sapiens; identical to SEQ ID NO: 27124
  ENSP00000419861

SEQ ID NO: 27128 - protein, 366 aa, Homo sapiens; identical to SEQ ID NO: 27123
  ENSP00000490357

SEQ ID NO: 27129 - protein, 365 aa, Homo sapiens; identical to SEQ ID NO: 27122
  ENSP00000490448

SEQ ID NO: 27130 - protein, 139 aa, Homo sapiens
  ENSP00000490068
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKIGSMDELEEGESYVCSSDNFFKKVEYT

SEQ ID NO: 27131 - protein, 113 aa, Homo sapiens
  ENSP00000418811
MELDFGHFDERDKTSRNMRGSRMNGLPSPTHSAHCSFYRTRTLQALSNEKKAKKVRFYRNGDRYFKGIVYAVSSDRFRSFDALLADLTRSLSDNINLPQGVRYIYTIDGSRKI

SEQ ID NO: 27132 - protein, 360 aa, Homo sapiens; identical to SEQ ID NO: 27124
  ENSP00000361061

SEQ ID NO: 27133 - protein, 879 aa, Homo sapiens
  ENSP00000378970
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDGSGINYSAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 27134 - protein, 900 aa, Homo sapiens
  ENSP00000327104
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 27135 - protein, 872 aa, Homo sapiens
  ENSP00000350401
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGGATGGSPGERKRTRLGGPAARHRYEVVTELGPEEVRWFYKEDKKTWKPFIGYDSLRIELAFRTLLQTTGARPQGGDRDGDHVCSPTGPASSSGEDDDEDRACGFCQSTTGHEPEMVELVNIEPVCVRGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSALELDHRIDFELREGLVESRYWSAVTSHTAYWSSLDVALFLLTFMYKHEHDDDAKPNLDPI

SEQ ID NO: 27136 - protein, 92 aa, Homo sapiens
  ENSP00000450785
MRGQWFIDGTWQPLEEEESNLIEQEHLNCFRGQQMQENFDIEVSKSIDGKDAVHSFKLSRNHVDWHSVDEVYLYSDATTSKIARTVTQKLGF

SEQ ID NO: 27137 - protein, 771 aa, Homo sapiens
  ENSP00000483405
MNYPGRGSPRSPEHNGRGGGGGAWELGSDARPAFGGGVCCFEHLPGGDPDDGDVPLALLRGEPGLHLAPGTDDHNHHLALDPCLSDENYDFSSAESGSSLRYYSEGESGGGGSSLSLHPPQQPPLVPTNSGGGLYEVDVTQGECYPVYWNQADKIPVMRGQWFIDGTWQPLEEEESNLIEQEHLNCFRGQQMQENFDIEVSKSIDGKDAVHSFKLSRNHVDWHSVDEVYLYSDATTSKIARTVTQKLGFSKASSSGTRLHRGYVEEATLEDKPSQTTHIVFVVHGIGQKMDQGRIIKNTAMMREAARKIEERHFSNHATHVEFLPVEWRSKLTLDGDTVDSITPDKVRGLRDMLNSSAMDIMYYTSPLYRDELVKGLQQELNRLYSLFCSRNPDFEEKGGKVSIVSHSLGCVITYDIMTGWNPVRLYEQLLQKEEELPDERWMSYEERHLLDELYITKRRLKEIEERLHGLKASSMTQTPALKFKVENFFCMGSPLAVFLALRGIRPGNTGSQDHILPREICNRLLNIFHPTDPVAYRLEPLILKHYSNISPVQIHWYNTSNPLPYEHMKPSFLNPAKEPTSVSENEGISTIPSPVTSPVLSRRHYGESITNIGKASILGAASIGKGLGGMLFSRFGRSSTTQSSETSKDSMEDEKKPVASPSATTVGTQTLPHSSSGFLDSAYFRLQESFFNLPQLLFPENVMQNKDNALVELDHRIDFELREGLVESRYWSAVTSHTAYWSSLDVALFLLTFMYKHEHDDDAKPNLDPI

SEQ ID NO: 27138 - protein, 169 aa, Homo sapiens
  ENSP00000447188
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 27139 - protein, 192 aa, Homo sapiens
  ENSP00000448665
MELVPATPHYPADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 27140 - protein, 169 aa, Homo sapiens; identical to SEQ ID NO: 27138
  ENSP00000340671

SEQ ID NO: 27141 - protein, 192 aa, Homo sapiens; identical to SEQ ID NO: 27139
  ENSP00000447803

SEQ ID NO: 27142 - protein, 145 aa, Homo sapiens
  ENSP00000447503
MELVPATPHYPADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKE

SEQ ID NO: 27143 - protein, 232 aa, Homo sapiens
  ENSP00000307305
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 27144 - protein, 193 aa, Homo sapiens
  ENSP00000354830
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLVKKKLYSLIGTTVIEGS

SEQ ID NO: 27145 - protein, 177 aa, Homo sapiens
  ENSP00000427301
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDSSVVPTFELTLVFKQENCSWTSFRDFFFSRGRFSSGFRRTLILSSGFRLV

SEQ ID NO: 27146 - protein, 128 aa, Homo sapiens
  ENSP00000427040
MVATGSLSSKNPASISELLDCGYHPESLLSDFDYWDYVVPEPNLNEVIFEESTCQNLVKMLENCLSKSKQTKLGCSKVLVPEKLTQRIAQDVLRLSSTEPCGLRGCVMHVNLEIENVCKKLDRIVCDS

SEQ ID NO: 27147 - protein, 711 aa, Homo sapiens
  ENSP00000390590
MLDGPLFSEGPDSPRELQDEESGSCLWVQKSKLLVIEVKTISCHYSRRAPSRQPMDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVISQTEEVLFGVRDIRGTQQGNRKRQ

SEQ ID NO: 27148 - protein, 369 aa, Homo sapiens
  ENSP00000357920
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 27149 - protein, 310 aa, Homo sapiens
  ENSP00000357919
MRPARHWETRFGARDFGGFQDCFFRDRLMDTARIAVVGAGVVGLSTAVCISKLVPRCSVTIISDKFTPDTTSDVAAGMLIPHTYPDTPIHTQKQWFRETFNHLFAIANSAEAGDAGVHLVSGIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 27150 - protein, 110 aa, Homo sapiens
  ENSP00000436642
MRPARHWETRFGARDFGGFQDCFFRDRLMDTARIAVVGAGVVGLSTAVCISKLVPRCSVTIISDKFTPDTTSDVAAGMLIPHTYPVGRYFRALRLKKCHSGLTWFWDFER

SEQ ID NO: 27151 - protein, 130 aa, Homo sapiens
  ENSP00000400309
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWI

SEQ ID NO: 27152 - protein, 148 aa, Homo sapiens
  ENSP00000391310
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPY

SEQ ID NO: 27153 - protein, 855 aa, Homo sapiens
  ENSP00000356899
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 27154 - protein, 855 aa, Homo sapiens; identical to SEQ ID NO: 27153
  ENSP00000356898

SEQ ID NO: 27155 - protein, 166 aa, Homo sapiens
  ENSP00000417030
LKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRVSREKPQQASGRYDTPAPSSLHLFLVSANLLRSPHSLSRFGLPLLLA

SEQ ID NO: 27156 - protein, 171 aa, Homo sapiens
  ENSP00000396864
  MOD_RES (1)..(1): Any amino acid
XIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVS

SEQ ID NO: 27157 - protein, 660 aa, Homo sapiens
  ENSP00000353284
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 27158 - protein, 224 aa, Homo sapiens
  ENSP00000398953
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQT

SEQ ID NO: 27159 - protein, 660 aa, Homo sapiens; identical to SEQ ID NO: 27157
  ENSP00000336725

SEQ ID NO: 27160 - protein, 250 aa, Homo sapiens
  ENSP00000400377
MEIGRPRKDTWKLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVK

SEQ ID NO: 27161 - protein, 483 aa, Homo sapiens
  ENSP00000247003
MAGFAELGLSSWLVEQCRQLGLKQPTPVQLGCIPAILEGRDCLGCAKTGSGKTAAFVLPILQKLSEDPYGIFCLVLTPTRELAYQIAEQFRVLGKPLGLKDCIIVGGMDMVAQALELSRKPHVVIATPGRLADHLRSSNTFSIKKIRFLVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASRGLDIPTVQVVINHNTPGLPKIYIHRVGRTARAGRQGQAITLVTQYDIHLVHAIEEQIKKKLEEFSVEEAEVLQILTQVNVVRRECEIKLEAAHFDEKKEINKRKQLILEGKDPDLEAKRKAELAKIKQKNRRFKEKVEETLKRQKAGRAGHKGRPPRTPSGSHSGPVPSQGLV

SEQ ID NO: 27162 - protein, 118 aa, Homo sapiens
  ENSP00000470440
MAGFAELGLSSWLVEQCRQLGLKQPTPVQLGCIPAILEGRDCLGCAKTGSGKTAAFVLPILQKLSEDPYGIFCLVLTPTRIKQDGPGAVAHTCNPSTLGAPGSWPTRSQSSSGSWGSL

SEQ ID NO: 27163 - protein, 166 aa, Homo sapiens
  ENSP00000471292
MAGFAELGLSSWLVEQCRQLGLKQPTPVQLGCIPAILEGRDCLGCAKTGSGKTAAFVLPILQKLSEDPYGIFCLVLTPTRGPAELNKMAPVQWLTPVIPALWELQGAGLPDRRAVPGPGEASRAERLHHRRWHGHGGPGAGALSETTRGHRHAGAPGRSPAQLQHF

SEQ ID NO: 27164 - protein, 41 aa, Homo sapiens
  ENSP00000472289
MAGFAELGLSSWLVEQCRQLGLKQPTPVQLGCIPAILEEAV

SEQ ID NO: 27165 - protein, 112 aa, Homo sapiens
  ENSP00000472084
MAGFAELGLSSWLVEQCRQLGLKQPTPVQLGCIPAILEGRDCLGCAKTGSGKTAAFVLPILQKLSEDPYGIFCLVLTPTRHGGPGAGALSETTRGHRHAGAPGRSPAQLQHF

SEQ ID NO: 27166 - protein, 41 aa, Homo sapiens; identical to SEQ ID NO: 27164
  ENSP00000469086

SEQ ID NO: 27167 - protein, 166 aa, Homo sapiens; identical to SEQ ID NO: 27163
  ENSP00000487048

SEQ ID NO: 27168 - protein, 321 aa, Homo sapiens
  ENSP00000336972
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 27169 - protein, 326 aa, Homo sapiens
  ENSP00000470082
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDIRLRVRAEYCEHGPALEQGVASRRPQALARQLDVFGQATAVLRSRDLGSVVCDIKFSELSYLDAFWGDYLSGALLQALRGVFLTEALREAVGREAVRLLVSVDEADYEAGRRRLLLMEEEGGRRPTEAS

SEQ ID NO: 27170 - protein, 326 aa, Homo sapiens; identical to SEQ ID NO: 27169
  ENSP00000471512

SEQ ID NO: 27171 - protein, 204 aa, Homo sapiens
  ENSP00000469233
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSYGTSSSSKRTEGSCRRRRQSSSSANSQQGQWETGSPPTKRQRRSRGRPSGGARRRRRGAPAAPQQQSEPARPSSEGKVTCDGETGSER

SEQ ID NO: 27172 - protein, 117 aa, Homo sapiens
  ENSP00000469898
MALSGSTPAPCWEEDECLDYYGMLSLHRMFEVVGGQLTECELELLAFLLDEAPGAAGGLARARSGLELLLELERRGQCDESNLRLLGQLLRVLARHDLLPHLARKRRRPVSPERYSY

SEQ ID NO: 27173 - protein, 529 aa, Homo sapiens
  ENSP00000265036
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQIKYPGADMDITLSAPSFCRQISPEEFEYQRSYGSQEPLAALLEEVITDAKLSNKEKKKKLKQFQKSYPEVYQERFPTPESAALLFPEKPKPKPQLLMWALKKPFQPFQRTRSFRM

SEQ ID NO: 27174 - protein, 467 aa, Homo sapiens
  ENSP00000389101
MEHRIVGPGPYRATRLWNETVELFRAKMPLRKHRCRFKSYEHCFTAAEAVDWLHELLRCSQNFGPEVTRKQTVQLLKKFLKNHVIEDIKGKWGEEDFEDNRHLYRFPPSSPLKPYPKKPPNQKDVIKFPEWNDLPPGTSQENIPVRPVVMNSEMWYKRHSIAIGEVPACRLVHRRQLTEANVEEIWKSMTLSYLQKILGLDSLEEVLDVKLVNSKFIIHNVYSVSKQGVVILDDKSKELPHWVLSAMKCLANWPNCSDLKQPMYLGFEKDVFKTIADYYGHLKEPLLTFHLFDAFVSVLGLLQKEKVAVEAFQICCLLLPPENRRKLQLLMRMMARICLNKEMPPLCDGFGTRTLMVQTFSRCILCSKDEVDLDELLAARLVTFLMDNYQEILKVPLALQTSIEERVAHLRRVQFQKSYPEVYQERFPTPESAALLFPEKPKPKPQLLMWALKKPFQPFQRTRSFRM

SEQ ID NO: 27175 - protein, 22 aa, Homo sapiens
  ENSP00000427527
MEHRIVGPGPYRATRLGLILLS

SEQ ID NO: 27176 - protein, 36 aa, Homo sapiens
  ENSP00000426979
MEHRIVGPGPYRATRLFLFLRPGAVAHSCNSSTLGG

SEQ ID NO: 27177 - protein, 511 aa, Homo sapiens
  ENSP00000241051
MATVQEKAAALNLSALHSPAHRPPGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 27178 - protein, 502 aa, Homo sapiens
  ENSP00000308971
MRGLCEFYWQEFGIKGFSVAQKPFGATYVWSSIINTLQTQVEVKKRRHRLKRHNDCFVGSEAVDVIFSHLIQNKYFGDVDIPRAKVVRVCQALMDYKVFEAVPTKVFGKDKKPTFEDSSCSLYRFTTIPNQDSQLGKENKLYSPARYADALFKSSDIRSASLEDLWENLSLKPANSPHVNISATLSPQVINEVWQEETIGRLLQLVDLPLLDSLLKQQEAVPKIPQPKRQSTMVNSSNYLDRGILKAYSDSQEDEWLSAAIDCLEYLPDQMVVEISRSFPEQPDRTDLVKELLFDAIGRYYSSREPLLNHLSDVHNGIAELLVNGKTEIALEATQLLLKLLDFQNREEFRRLLYFMAVAANPSEFKLQKESDNRMVVKRIFSKAIVDNKNLSKGKTDLLVLFLMDHQKDVFKIPGTLHKIVSVKLMAIQNGRDPNRDAGYIYCQRIDQRDYSNNTEKTTKDELLNLLKTLDEDSKLSAKEKKKLLGQFYKCHPDIFIEHFGD

SEQ ID NO: 27179 - protein, 470 aa, Homo sapiens
  ENSP00000363071
MSQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 27180 - protein, 496 aa, Homo sapiens
  ENSP00000339587
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 27181 - protein, 332 aa, Homo sapiens
  ENSP00000387119
MQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 27182 - protein, 496 aa, Homo sapiens; identical to SEQ ID NO: 27180
  ENSP00000386670

SEQ ID NO: 27183 - protein, 55 aa, Homo sapiens
  ENSP00000395540
QLFMTAYFLVSALAEMPDSAAALLGTCCKLQIIPTLCHLVSNLPGGTLEWIGMGK

SEQ ID NO: 27184 - protein, 155 aa, Homo sapiens
  ENSP00000389874
  MOD_RES (1)..(1): Any amino acid
XAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVKDILGRSSSLTLSCTNGESHTSCQPSSHPDSVSSLS

SEQ ID NO: 27185 - protein, 192 aa, Homo sapiens
  ENSP00000398445
  MOD_RES (1)..(1): Any amino acid
XEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVQKDILGRSSSLTLSCTNGESHTSCQPSSHPDSVSSLS

SEQ ID NO: 27186 - protein, 216 aa, Homo sapiens
  ENSP00000414090
VKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFAPLCLPWWSCPVLLMASGECVTPPQLTESSAFSEGSKVASRTRRELTLSTWTPWSFESLHS

SEQ ID NO: 27187 - protein, 18 aa, Homo sapiens
  ENSP00000413963
MQKCVISEHMQVEEKCGG

SEQ ID NO: 27188 - protein, 332 aa, Homo sapiens; identical to SEQ ID NO: 27181
  ENSP00000401332

SEQ ID NO: 27189 - protein, 58 aa, Homo sapiens
  ENSP00000446515
MAKERGLISPSDFAQLQKYMEYSTKKVSDVLKLFEDGEMAKYVQGDAIGYEGFQQFLK

SEQ ID NO: 27190 - protein, 21 aa, Homo sapiens
  ENSP00000449178
MAKERGLISPSDFAQLQKYME

SEQ ID NO: 27191 - protein, 735 aa, Homo sapiens
  ENSP00000328405
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 27192 - protein, 44 aa, Homo sapiens
  ENSP00000452353
MAKERGLISPSDFAQLQKYMEYSTKKVSDVLKLFEDGEMAKYVQ

SEQ ID NO: 27193 - protein, 94 aa, Homo sapiens
  ENSP00000450977
MAKERGLISPSDFAQLQKYMESSSVALSSVLLRCAHDWKWEEWEMGRCQKKIRIYHSLTGLHCARSRLSTHLRYTWTACSSSQRRGVKSDSTKK

SEQ ID NO: 27194 - protein, 545 aa, Homo sapiens
  ENSP00000451743
MAKERGLISPSDFAQLQKYMEYSTKKGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGIN

SEQ ID NO: 27195 - protein, 118 aa, Homo sapiens
  ENSP00000446605
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEWS

SEQ ID NO: 27196 - protein, 118 aa, Homo sapiens; identical to SEQ ID NO: 27195
  ENSP00000448565

SEQ ID NO: 27197 - protein, 147 aa, Homo sapiens
  ENSP00000447050
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAE

SEQ ID NO: 27198 - protein, 44 aa, Homo sapiens; identical to SEQ ID NO: 27192
  ENSP00000450608

SEQ ID NO: 27199 - protein, 735 aa, Homo sapiens; identical to SEQ ID NO: 27191
  ENSP00000450359

SEQ ID NO: 27200 - protein, 247 aa, Homo sapiens
  ENSP00000385792
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNRPITCVGARRL

SEQ ID NO: 27201 - protein, 107 aa, Homo sapiens
  ENSP00000450999
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLE

SEQ ID NO: 27202 - protein, 44 aa, Homo sapiens; identical to SEQ ID NO: 27192
  ENSP00000451814

SEQ ID NO: 27203 - protein, 116 aa, Homo sapiens
  ENSP00000402307
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLE

SEQ ID NO: 27204 - protein, 133 aa, Homo sapiens
  ENSP00000451266
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSS

SEQ ID NO: 27205 - protein, 133 aa, Homo sapiens; identical to SEQ ID NO: 27204
  ENSP00000447460

SEQ ID NO: 27206 - protein, 116 aa, Homo sapiens; identical to SEQ ID NO: 27203
  ENSP00000449923

SEQ ID NO: 27207 - protein, 97 aa, Homo sapiens
  ENSP00000451330
CNLCESSIGLGKQGLSCNLCKYTVHDQCAMKALPCEVSTYAKSRKDIGPLPPLGPAQTLPDKELPFSPRSNHMCGCEEAVSPGAATAVRKRSGSTTV

SEQ ID NO: 27208 - protein, 202 aa, Homo sapiens
  ENSP00000451518
LRIDPVPNTHPLLVFVNPKSGGKQGQRLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNL

SEQ ID NO: 27209 - protein, 735 aa, Homo sapiens; identical to SEQ ID NO: 27191
  ENSP00000377703

SEQ ID NO: 27210 - protein, 804 aa, Homo sapiens [sequence omitted]

SEQ ID NO: 27211 - protein, 803 aa, Homo sapiens
  ENSP00000384909
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 27212 - protein, 796 aa, Homo sapiens
  ENSP00000385031
MTNQEKWAHLSPSEFSQLQKYAEYSTKKLKDVLEEFHGNGVLAKYNPEGTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTIKITHKNQAPMLMGPPPKTGLFCSLVKRTRNRSKE

SEQ ID NO: 27213 - protein, 773 aa, Homo sapiens
  ENSP00000386066
MTNQEKWAHLSPSEFSQLQKYAEYSTKKLKDVLEEFHGNGVLAKYNPEGKQDILNQTIDFEGFKLFMKTFLEAELPDDFTAHLFMSFSNKFPHSSPMVKSKPALLSGGLRMNKGAITPPRTTSPANTCSPEVIHLKDIVCYLSLLERGRPEDKLEFMFRLYDTDGNGFLDSSELENIISQMMHVAEYLEWDVTELNPILHEMMEEIDYDHDGTVSLEEWIQGGMTTIPLLVLLGLENNVKDDGQHVWRLKHFNKPAYCNLCLNMLIGVGKQGLCCSFCKYTVHERCVARAPPSCIKTYVKSKRNTDVMHHYWVEGNCPTKCDKCHKTVKCYQGLTGLHCVWCQITLHNKCASHLKPECDCGPLKDHILPPTTICPVVLQTLPTSGVSVPEERQSTVKKEKSGSQQPNKVIDKNKMQRANSVTVDGQGLQVTPVPGTHPLLVFVNPKSGGKQGERIYRKFQYLLNPRQVYSLSGNGPMPGLNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKRRSHRRIEKKGSDKRTTVTDAKELKFASQDLSDQLLEVVGLEGAMEMGQIYTGLKSAGRRLAQCSCVVIRTSKSLPMQIDGEPWMQTPCTVSTE

SEQ ID NO: 27214 - protein, 75 aa, Homo sapiens
  ENSP00000405569
MTNQEKWAHLSPSEFSQLQKYAEYSTKKLKDVLEEFHGNGVLAKYNPEGKQDILNQTIDFEGFKLFMKTFLEAEL

SEQ ID NO: 27215 - protein, 804 aa, Homo sapiens [sequence omitted]

SEQ ID NO: 27216 - protein, 1220 aa, Homo sapiens
  ENSP00000337572
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 27217 - protein, 1164 aa, Homo sapiens
  ENSP00000261491
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 27218 - protein, 62 aa, Homo sapiens
  ENSP00000482250
AAAGAGAAVTSAAASAGPGEDSSDSEAEQEGPQKLIRKVSTSGQIRTKGFIMLARLVTSELK

SEQ ID NO: 27219 - protein, 1084 aa, Homo sapiens
  ENSP00000485809
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 27220 - protein, 1028 aa, Homo sapiens
  ENSP00000486838
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPALPLHSVLHLLWPTFAL

SEQ ID NO: 27221 - protein, 89 aa, Homo sapiens
  ENSP00000486329
MLCAENRKEMEDWISSLKSVQTREPYEVAQFNVEHFSGMHNWYACSHARPTFCNVCRESLSGVTSHGLSCEGTHCLQRFIPSNMSTWSM

SEQ ID NO: 27222 - protein, 1100 aa, Homo sapiens
  ENSP00000445114
MLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKNTVGEKRDTKENGKHMDLGIPKVGHVKRILQGIKELGRSTPQSEV

SEQ ID NO: 27223 - protein, 1164 aa, Homo sapiens; identical to SEQ ID NO: 27217
  ENSP00000368576

SEQ ID NO: 27224 - protein, 734 aa, Homo sapiens
  ENSP00000392161
MLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDATSADRFYRIDRSQEHLHFVMEISQDEIFILDPDMVVSQPAGTPPGMPDLVVEQASGSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 27225 - protein, 1065 aa, Homo sapiens
  ENSP00000288490
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 27226 - protein, 1047 aa, Homo sapiens
  ENSP00000399131
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 27227 - protein, 1078 aa, Homo sapiens
  ENSP00000396078
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDIHQVQTADLRRVSAPPGSFTIPQSVPDRLRIRVNKISLQDYEGFHYDKEKLREASIPLGILVVRGDCDLETCRMYIDRLQEDLQSVSSGSQRVHYQDHETSFPRALSAQRLSPRWCFLDATSADRFYRIDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 27228 - protein, 932 aa, Homo sapiens
  ENSP00000479053
RKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 27229 - protein, 73 aa, Homo sapiens
  ENSP00000403529
MSWIKEGELSLWERFCANIIKAGPMPKHIAFIMDGNRRYAKKCQVERQEGHSQGFNKLAELLAFSPLRLCGGV

SEQ ID NO: 27230 - protein, 198 aa, Homo sapiens
  ENSP00000399177
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSRDRFHHIGQASLELLTS

SEQ ID NO: 27231 - protein, 299 aa, Homo sapiens
  ENSP00000434984
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNNDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 27232 - protein, 333 aa, Homo sapiens
  ENSP00000236342
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 27233 - protein, 294 aa, Homo sapiens
  ENSP00000434219
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQKARDMYAEERKRQQLERDQATVTEQLLREGLQASGDAQLRRTRLHKLSARREERVQGFLQALELKRADWLARLGTASA

SEQ ID NO: 27234 - protein, 209 aa, Homo sapiens
  ENSP00000363300
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPRYPELFCMVIVKENRPGPAWQLTPVILAH

SEQ ID NO: 27235 - protein, 334 aa, Homo sapiens
  ENSP00000353104
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQQKARDMYAEERKRQQLERDQATVTEQLLREGLQASGDAQLRRTRLHKLSARREERVQGFLQALELKRADWLARLGTASA

SEQ ID NO: 27236 - protein, 165 aa, Homo sapiens
  ENSP00000436119
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNA

SEQ ID NO: 27237 - protein, 130 aa, Homo sapiens
  ENSP00000436764
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLD

SEQ ID NO: 27238 - protein, 122 aa, Homo sapiens
  ENSP00000434185
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLG

SEQ ID NO: 27239 - protein, 71 aa, Homo sapiens
  ENSP00000431407
MSWIKEGELSLWERFCANIIKAGPMPKHIAFIMDGNRRYAKKCQVERQEGHSQGFNKLAETLRWCLNLGIL

SEQ ID NO: 27240 - protein, 85 aa, Homo sapiens
  ENSP00000433976
MSWIKEGELSLWERFCANIIKAGPMPKHIAFIMDGNRRYAKKCQVERQEGHSQGFNKLAETLRWCLNLGILEVTVYAFSIENFKR

SEQ ID NO: 27241 - protein, 173 aa, Homo sapiens
  ENSP00000405604
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGV

SEQ ID NO: 27242 - protein, 60 aa, Homo sapiens
  ENSP00000433491
MSWIKEGELSLWERFCANIIKAGPMPKHIAFIMDGNRRYAKKCQVERQEGHSQGFNKLAE

SEQ ID NO: 27243 - protein, 216 aa, Homo sapiens
  ENSP00000397584
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQ

SEQ ID NO: 27244 - protein, 169 aa, Homo sapiens
  ENSP00000399781
LARQKFSRLMEEKEKLQKHGVCIRVLGDLHLLPLDLQELIAQAVQATKNYNNDISESLLDKCLYTNRSPHPDILIRTSGEVRLSDFLLWQQKARDMYAEERKRQQLERDQATVTEQLLREGLQASGDAQLRRTRLHKLSARREERVQGFLQALELKRADWLARLGTASA

SEQ ID NO: 27245 - protein, 162 aa, Homo sapiens
  ENSP00000393961
  MOD_RES (1)..(1): Any amino acid
XHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQHPGSLLTKAWKKPFQQDGELYGNCSSPKSS

SEQ ID NO: 27246 - protein, 187 aa, Homo sapiens
  ENSP00000396308
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 27247 - protein, 187 aa, Homo sapiens; identical to SEQ ID NO: 27246
  ENSP00000426474

SEQ ID NO: 27248 - protein, 129 aa, Homo sapiens
  ENSP00000422732
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKIPRCSL

SEQ ID NO: 27249 - protein, 135 aa, Homo sapiens
  ENSP00000421334
MGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 27250 - protein, 199 aa, Homo sapiens
  ENSP00000364919
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVESIPIMLVGNKCDESPSREVQSSEAEALARTWKCAFMETSAKLNHNVKELFQELLNLEKRRTVSLQIDGKKSKQQKRKEKLKGKCVIM

SEQ ID NO: 27251 - protein, 112 aa, Homo sapiens
  ENSP00000490457
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVE

SEQ ID NO: 27252 - protein, 43 aa, Homo sapiens
  ENSP00000490853
MPEQSNDYRVAVFGAGGVGKSSLVLRFVKGTFRESYIPTVEDT

SEQ ID NO: 27253 - protein, 1401 aa, Homo sapiens
  ENSP00000267889
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 27254 - protein, 1392 aa, Homo sapiens
  ENSP00000294484
MDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGGPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 27255 - protein, 268 aa, Homo sapiens
  ENSP00000303400
MSRYLKNLLEQDHVQGQILLPDLLGLPALGELPPAAAAGLARGLSPAPGLPDLRALEADIHGNRRGAERPVRPGAIPAHLRGRGGRVHHPHPAPAARAPQHLGHRVPGGDHHVLERLGDGGCGSHLPVHPRWLLRGLLRPPGRGLPAGWREPAPPPGRGRPNAAPVAYAGGRAARGRGHRLQCPHHGHRHSAPLLLHHRPICQVRQDCGTQHGRVHPLHADRQHRPAGHHGAQLFHSDPDFLPQGPGCRAAGRGPGAGCLPRAPAERL

SEQ ID NO: 27256 - protein, 218 aa, Homo sapiens
  ENSP00000434130
MGTQVVMRFNNSLLPTEPSQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 27257 - protein, 683 aa, Homo sapiens
  ENSP00000394352
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 27258 - protein, 77 aa, Homo sapiens
  ENSP00000479434
MEEAKKMISGLQALLLNGSLPEDEQERPLALCEPGVNPEEQLIIIQSRLDQSMEENQDLKKELLKCKQEARNLQGIK

SEQ ID NO: 27259 - protein, 472 aa, Homo sapiens
  ENSP00000480808
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 27260 - protein, 224 aa, Homo sapiens
  ENSP00000220812
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 27261 - protein, 1528 aa, Homo sapiens
  ENSP00000276297
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 27262 - protein, 1091 aa, Homo sapiens
  ENSP00000351797
MCRKKPDTMILTQIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 27263 - protein, 1125 aa, Homo sapiens
  ENSP00000422595
MGDPKAHVMARPLRAPLRRSFSDHIRDSTARALDVIWKNTRDRRLAEIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 27264 - protein, 1017 aa, Homo sapiens
  ENSP00000428028
MKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 27265 - protein, 48 aa, Homo sapiens
  ENSP00000429537
MSLVPSVANGLSKGTARGGPGLKSLMSFLQNKTWSLGPQTTPTRRTAP

SEQ ID NO: 27266 - protein, 498 aa, Homo sapiens
  ENSP00000321034
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAAVKSVKLEVDEDKSTKGSNFSNSEVAIGLSPYTFPQKRLFHVAGEENIT

SEQ ID NO: 27267 - protein, 463 aa, Homo sapiens
  ENSP00000425878
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLTDDKQVLNTQGQKTSGQHMIQGAGSLEKALPIIQSNQVSSNSWGIAGETELALVKESGERKVTDSISKSLELCNEISLSEIKDAPKVNAVDTLNVKDIAPEKQLLNSAVIAQQRRKPDPPKDENERSTCNVVQNEFLDTPCTNRGLPLLKTDFGSCLLQPPSCPNGMSAENGLEKSGFSQHQNKSPPKVKAEDGMQCLQLKETLATQEPTDNQVRLRKRKEIREDRDRARLDSMVLLIMKLDQLDQDIENALSTSSSPSGTPTNLRRHVPDLESGSESGADTISVNQTRVNLSSDTESTDLPSSTPVANSGTKPKTTAIQGISEKEKAGKLTFWFCFLANLF

SEQ ID NO: 27268 - protein, 75 aa, Homo sapiens
  ENSP00000473289
  MOD_RES (1)..(1): Any amino acid
XLLQPPSCPNGMSAENGLEKSGFSQHQNKSPPKVKAEDGMQCLQLKETLATQEPTDNQVRLRKRKVRHMHRFSGF

SEQ ID NO: 27269 - protein, 122 aa, Homo sapiens
  ENSP00000488100
MSVAIRKRSWEEHVTHWMGQPFNSDDRNTACHHGLVADSLQASMEKDATLNVDRKEKCVSLPDCCHGSELRDFPGRPMGHLSKDVDENDSHEGEDQFLSLEASTETLVHVSDEDNNADLCLT

SEQ ID NO: 27270 - protein, 926 aa, Homo sapiens
  ENSP00000345731
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27271 - protein, 904 aa, Homo sapiens
  ENSP00000407531
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27272 - protein, 788 aa, Homo sapiens
  ENSP00000398939
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27273 - protein, 853 aa, Homo sapiens
  ENSP00000413238
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27274 - protein, 904 aa, Homo sapiens; identical to SEQ ID NO: 27271
  ENSP00000391732

SEQ ID NO: 27275 - protein, 800 aa, Homo sapiens
  ENSP00000396658
MNYIFGNNTLLYSRGSRGGNTSSSHGSAGPKQKHWAKKGSSDELQAEPEPSRWQQIVAFFTRRHSFIDCISVATSSTQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYLILITDEYGCSKGGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27276 - protein, 893 aa, Homo sapiens
  ENSP00000411278
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27277 - protein, 871 aa, Homo sapiens
  ENSP00000376187
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGEIPDDMGSKGLKHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27278 - protein, 370 aa, Homo sapiens
  ENSP00000396768
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITN

SEQ ID NO: 27279 - protein, 658 aa, Homo sapiens
  ENSP00000376186
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRYACFLPLECEAT

SEQ ID NO: 27280 - protein, 286 aa, Homo sapiens
  ENSP00000398702
FFTRRHSFIDCISVATSSTQANPPPVLVNTDSLETPTYGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLG

SEQ ID NO: 27281 - protein, 122 aa, Homo sapiens
  ENSP00000412579
MDCLCIVTTKKYRYQDEDTPPQEHISPQITNEVIGPELVHVSEKNLSEIENVHGFVSHSHISPIKVNGTDADYEYEEITLERGNSGLGFSIAGGTDNPHIGDDSSIFITKIITGGAAAQDGR

SEQ ID NO: 27282 - protein, 179 aa, Homo sapiens
  ENSP00000396474
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTY

SEQ ID NO: 27283 - protein, 208 aa, Homo sapiens
  ENSP00000376185
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLE

SEQ ID NO: 27284 - protein, 154 aa, Homo sapiens
  ENSP00000414189
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSH

SEQ ID NO: 27285 - protein, 123 aa, Homo sapiens
  ENSP00000393771
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISP

SEQ ID NO: 27286 - protein, 106 aa, Homo sapiens
  ENSP00000390403
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVE

SEQ ID NO: 27287 - protein, 35 aa, Homo sapiens
  ENSP00000400169
MPVRKQDTQRALHLLEEYRSKLSQTEDRQLRSSIE

SEQ ID NO: 27288 - protein, 892 aa, Homo sapiens
  ENSP00000350303
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 27289 - protein, 724 aa, Homo sapiens
  ENSP00000382425
MDCLCIVTTKKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 27290 - protein, 721 aa, Homo sapiens
  ENSP00000307471
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 27291 - protein, 767 aa, Homo sapiens
  ENSP00000382428
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 27292 - protein, 85 aa, Homo sapiens
  ENSP00000467897
  MOD_RES (1)..(1): Any amino acid
XGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 27293 - protein, 296 aa, Homo sapiens
  ENSP00000460625
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTCESPSNTKVPHDPSRLTHDMQSHDIPVAVPLQIFPMK

SEQ ID NO: 27294 - protein, 281 aa, Homo sapiens
  ENSP00000407918
MPINGVNLAWKYRYQDEDTPPLEHSPAHLPNQVNAPELVHVAERNLSHLEAGHGVVGHAHLSPFKANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSN

SEQ ID NO: 27295 - protein, 234 aa, Homo sapiens
  ENSP00000388122
MDCLCIVTTKKYRYQDEDTPPLEHSPAHLPNQVNAPELVHVAERNLSHLEAGHGVVGHAHLSPFKANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDG

SEQ ID NO: 27296 - protein, 115 aa, Homo sapiens
  ENSP00000465720
MEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIA

SEQ ID NO: 27297 - protein, 91 aa, Homo sapiens
  ENSP00000465789
MEYEEITLERGNSGLGFSIAGGTDNPHIGDDPSIFITKIIPGGAAAQDGRLRVNDSILFVNEVDVREVTHSAAVEALKEAGSIVRLYVMRR

SEQ ID NO: 27298 - protein, 975 aa, Homo sapiens
  ENSP00000478085
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILQEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27299 - protein, 961 aa, Homo sapiens
  ENSP00000488195
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILQEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27300 - protein, 961 aa, Homo sapiens; identical to SEQ ID NO: 27299
  ENSP00000483427

SEQ ID NO: 27301 - protein, 561 aa, Homo sapiens
  ENSP00000488273
  MOD_RES (1)..(1): Any amino acid
XQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27302 - protein, 575 aa, Homo sapiens
  ENSP00000488705
  MOD_RES (1)..(1): Any amino acid
XQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27303 - protein, 176 aa, Homo sapiens
  ENSP00000487701
  MOD_RES (1)..(1): Any amino acid
XTATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEESKSSGFPRAS

SEQ ID NO: 27304 - protein, 158 aa, Homo sapiens
  ENSP00000488020
SAVRTVRTQGLFSYREDYRTQVDTSTLPPPDPWLEPAIDTVETGRMSPCRRDGSWFLKLLHAETKRMEGWCKEMEREAEENDLSEEKLLPAHALQENALALCQREVDGGDDGRRMLGRCCLPRDPQSPQHGCMGLVQVSTAVFRSFTRRLHFSWLGYI

SEQ ID NO: 27305 - protein, 400 aa, Homo sapiens
  ENSP00000487728
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQ

SEQ ID NO: 27306 - protein, 400 aa, Homo sapiens; identical to SEQ ID NO: 27305
  ENSP00000488908

SEQ ID NO: 27307 - protein, 1055 aa, Homo sapiens
  ENSP00000489774
MSALRKVLPGILQKHCCILPDRNTESQCTLCGEPEEEEAGDLVQPGISFPGPAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27308 - protein, 1054 aa, Homo sapiens
  ENSP00000400258
MGTAQVLPGILQKHCCILPDRNTESQCTLCGEPEEEEAGDLVQPGISFPGPAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27309 - protein, 978 aa, Homo sapiens
  ENSP00000430563
  MOD_RES (1)..(1): Any amino acid
XPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27310 - protein, 176 aa, Homo sapiens; identical to SEQ ID NO: 27303
  ENSP00000488645
  MOD_RES (1)..(1): Any amino acid

SEQ ID NO: 27311 - protein, 158 aa, Homo sapiens; identical to SEQ ID NO: 27304
  ENSP00000488445

SEQ ID NO: 27312 - protein, 961 aa, Homo sapiens
  ENSP00000484215
MKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESRGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRL

SEQ ID NO: 27313 - protein, 989 aa, Homo sapiens
  ENSP00000363023
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQERTRRNGSHLSEDNGPKAIDVMAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 27314 - protein, 992 aa, Homo sapiens
  ENSP00000363014
MKGLGDSRPRHLSDSLDPPHEPLFAGTDRNPYLLSPTEAFAREARFPGQNTLPGDGLFPLNNQLPPPSSTFPRIHYNSHFEVPEESPFPSHAQATKINRLPANLLDQFEKQLPIHRDGFSTLQFPRGEAKARGESPGRIRHLVHSVQRLFFTKAPSLEGTAGKVGGNGSKKGGMEDGKGRRAKSKERAKAGEPKRRSRSNISGWWSSDDNLDGEAGAFRSSGPASGLMTLGRQAERSQPRYFMHAYNTISGHMLKTTKNNTTELTAPPPPPAPPATCPSLGVGTDTNYVKRGSWSTLTLSHAHEVCQKTSATLDKSLLKSKSCHQGLAYHYLQVPGGGGEWSTTLLSPRETDAAAEGPIPCRRMRSGSYIKAMGDEDSDESGGSPKPSPKTAARRQSYLRATQQSLGEQSNPRRSLDRLDSVDMLLPSKCPSWEEDYTPVSDSLNDSSCISQIFGQASLIPQLFGHEQQVREAELSDQYEAACESACSEAESTAAETLDLPLPSYFRSRSHSYLRAIQAGCSQEEDSVSLQSLSPPPSTGSLSNSRTLPSSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 27315 - protein, 285 aa, Homo sapiens
  ENSP00000477723
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 27316 - protein, 46 aa, Homo sapiens
  ENSP00000480166
MSSRRDTDSDTQDANDSSCKSSERSLPDCTPHPNSISIDAGPRQAP

SEQ ID NO: 27317 - protein, 125 aa, Homo sapiens
  ENSP00000484696
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKEN

SEQ ID NO: 27318 - protein, 453 aa, Homo sapiens
  ENSP00000345700
MALCLELLKQCSSCLVAYKKTPPPVPPRTTSKPFISVTVQSSTESAQDTYLDSQDHKSEVTSQSGLSNSSDSLDSSTRPPSVTRGGVAPAPEAPEPPPKHAALKSEQGTLTSSESHPEAAPKRKLSSIGIQVDCIQPVPKEEPSPATKFQSIGVQVEDDWRSSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKEEKKPPPPVPKKPAKSKPAVSRDKASDASDKQRQEARKRLLAAKRAASVRQNSATESADSIEIYVPEAQTRL

SEQ ID NO: 27319 - protein, 244 aa, Homo sapiens
  ENSP00000419311
MAPSSESSVPSHSMSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEVLGKVLSAVGSAQLLMSQKFQQFRGLCEQNLNPDANPRPTAQDLAGFWDLLQLSIEDISMKFDELYHLKANSWQLVETPEKRKVSMEQCGGEVQGQIPGRQ

SEQ ID NO: 27320 - protein, 989 aa, Homo sapiens; identical to SEQ ID NO: 27313
  ENSP00000384954

SEQ ID NO: 27321 - protein, 992 aa, Homo sapiens; identical to SEQ ID NO: 27314
  ENSP00000341633

SEQ ID NO: 27322 - protein, 635 aa, Homo sapiens
  ENSP00000367997
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27323 - protein, 1386 aa, Homo sapiens
  ENSP00000350765
VSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27324 - protein, 3681 aa, Homo sapiens
  ENSP00000367948
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27325 - protein, 3685 aa, Homo sapiens
  ENSP00000354923
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27326 - protein, 617 aa, Homo sapiens
  ENSP00000367974
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27327 - protein, 1243 aa, Homo sapiens
  ENSP00000417123
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27328 - protein, 622 aa, Homo sapiens
  ENSP00000354464
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27329 - protein, 525 aa, Homo sapiens
  ENSP00000367951
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27330 - protein, 238 aa, Homo sapiens
  ENSP00000367977
LEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRDDEHL

SEQ ID NO: 27331 - protein, 30 aa, Homo sapiens
  ENSP00000417075
VEEILSKGQHLYKEKPATQPVKLLLRLLLW

SEQ ID NO: 27332 - protein, 134 aa, Homo sapiens
  ENSP00000417725
ELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKMN

SEQ ID NO: 27333 - protein, 101 aa, Homo sapiens
  ENSP00000399897
MLWWEEVEDCYEREDVQKKTFTKWVNAQFSKATQKEIEKQKVHLKSITEVGEALKTVLGKKETLVEDKLSLLNSNWIAVTSRAEEWLNLLLEYQKHMETFD

SEQ ID NO: 27334 - protein, 41 aa, Homo sapiens
  ENSP00000388559
MLWWEEVEDCYEREDVQKKTFTKWVNAQFSKEYQKHMETFD

SEQ ID NO: 27335 - protein, 772 aa, Homo sapiens
  ENSP00000288447
MEDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNVGYALIFISVLILCCL

SEQ ID NO: 27336 - protein, 125 aa, Homo sapiens
  ENSP00000395904
ENLFSDLQDGRRLLDLLEGLTGQKLPKEKGSTRVHALNNVNKALRVLQNNNVDLVNIGSTDIVDGNHKLTLGLIWNIILHWQVLGDRWANICRWTEDRWVLLQDILLKWQRLTEEQCLFSAWLSE

SEQ ID NO: 27337 - protein, 1225 aa, Homo sapiens
  ENSP00000367979
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27338 - protein, 956 aa, Homo sapiens
  ENSP00000340057
MLHRKTYHVKDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27339 - protein, 1115 aa, Homo sapiens
  ENSP00000444119
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27340 - protein, 1230 aa, Homo sapiens
  ENSP00000352894
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 27341 - protein, 3680 aa, Homo sapiens
  ENSP00000479270
MSEVSSDEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKVSLFVFSKHTFCLQRQKTGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27342 - protein, 3684 aa, Homo sapiens
  ENSP00000478150
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKVSLFVFSKHTFCLQRQKTGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 27343 - protein, 866 aa, Homo sapiens
  ENSP00000255189
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 27344 - protein, 613 aa, Homo sapiens
  ENSP00000430972
YLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKDQNSCFAHFKEENGWVSRWAIRPY

SEQ ID NO: 27345 - protein, 98 aa, Homo sapiens
  ENSP00000427834
MLRPGAQLLRGLLLRSCPLQGSPGRPRSVCGREGEEKPPLSAETQWKDRAETVIIGGGCVGVSLAYHLAKAGMKDVVLLEKSELTAGSTWHADFGLVK

SEQ ID NO: 27346 - protein, 106 aa, Homo sapiens
  ENSP00000428995
MLRPGAQLLRGLLLRSCPLQGSPGRPRSVCGREGEEKPPLSAETQWKDRAETVIIGGGCVGVSLAYHLAKAGMKDVVLLEKSELTAGSTWHAIWHNPRWWGREISQ

SEQ ID NO: 27347 - protein, 50 aa, Homo sapiens
  ENSP00000430133
MLRPGAQLLRGLLLRSCPLQGSPGRPRSVCGREGFNNLLSSWNKLEENTL

SEQ ID NO: 27348 - protein, 50 aa, Homo sapiens; identical to SEQ ID NO: 27347
  ENSP00000428092

SEQ ID NO: 27349 - protein, 513 aa, Homo sapiens
  ENSP00000340935
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 27350 - protein, 497 aa, Homo sapiens
  ENSP00000282479
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 27351 - protein, 4624 aa, Homo sapiens
  ENSP00000265104
MFRIGRRQLWKHSVTRVLTQRLKGEKEAKRALLDARHNYLFAIVASCLDLNKTEVEDAILEGNQIERIDQLFAVGGLRHLMFYYQDVEEAETGQLGSLGGVNLVSGKIKKPKVFVTEGNDVALTGVCVFFIRTDPSKAITPDNIHQEVSFNMLDAADGGLLNSVRRLLSDIFIPALRATSHGWGELEGLQDAANIRQEFLSSLEGFVNVLSGAQESLKEKVNLRKCDILELKTLKEPTDYLTLANNPETLGKIEDCMKVWIKQTEQVLAENNQLLKEADDVGPRAELEHWKKRLSKFNYLLEQLKSPDVKAVLAVLAAAKSKLLKTWREMDIRITDATNEAKDNVKYLYTLEKCCDPLYSSDPLSMMDAIPTLINAIKMIYSISHYYNTSEKITSLFVKVTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHNELRKFMDVTFAKIQNTNQALRMLKKFERLNIPNLGIDDKYQLILENYGADIDMISKLYTKQKYDPPLARNQPPIAGKILWARQLFHRIQQPMQLFQQHPAVLSTAEAKPIIRSYNRMAKVLLEFEVLFHRAWLRQIEEIHVGLEASLLVKAPGTGELFVNFDPQILILFRETECMAQMGLEVSPLATSLFQKRDRYKRNFSNMKMMLAEYQRVKSKIPAAIEQLIVPHLAKVDEALQPGLAALTWTSLNIEAYLENTFAKIKDLELLLDRVNDLIEFRIDAILEEMSSTPLCQLPQEEPLTCEEFLQMTKDLCVNGAQILHFKSSLVEEAVNELVNMLLDVEVLSEEESEKISNENSVNYKNESSAKREEGNFDTLTSSINARANALLLTTVTRKKKETEMLGEEARELLSHFNHQNMDALLKVTRNTLEAIRKRIHSSHTINFRDSNSASNMKQNSLPIFRASVTLAIPNIVMAPALEDVQQTLNKAVECIISVPKGVRQWSSELLSKKKIQERKMAALQSNEDSDSDVEMGENELQDTLEIASVNLPIPVQTKNYYKNVSENKEIVKLVSVLSTIINSTKKEVITSMDCFKRYNHIWQKGKEEAIKTFITQSPLLSEFESQILYFQNLEQEINAEPEYVCVGSIALYTADLKFALTAETKAWMVVIGRHCNKKYRSEMENIFMLIEEFNKKLNRPIKDLDDIRIAMAALKEIREEQISIDFQVGPIEESYALLNRYGLLIAREEIDKVDTLHYAWEKLLARAGEVQNKLVSLQPSFKKELISAVEVFLQDCHQFYLDYDLNGPMASGLKPQEASDRLIMFQNQFDNIYRKYITYTGGEELFGLPATQYPQLLEIKKQLNLLQKIYTLYNSVIETVNSYYDILWSEVNIEKINNELLEFQNRCRKLPRALKDWQAFLDLKKIIDDFSECCPLLEYMASKAMMERHWERITTLTGHSLDVGNESFKLRNIMEAPLLKYKEEIEDICISAVKERDIEQKLKQVINEWDNKTFTFGSFKTRGELLLRGDSTSEIIANMEDSLMLLGSLLSNRYNMPFKAQIQKWVQYLSNSTDIIESWMTVQNLWIYLEAVFVGGDIAKQLPKEAKRFSNIDKSWVKIMTRAHEVPSVVQCCVGDETLGQLLPHLLDQLEICQKSLTGYLEKKRLCFPRFFFVSDPALLEILGQASDSHTIQAHLLNVFDNIKSVKFHEKIYDRILSISSQEGETIELDKPVMAEGNVEVWLNSLLEESQSSLHLVIRQAAANIQETGFQLTEFLSSFPAQVGLLGIQMIWTRDSEEALRNAKFDKKIMQKTNQAFLELLNTLIDVTTRDLSSTERVKYETLITIHVHQRDIFDDLCHMHIKSPMDFEWLKQCRFYFNEDSDKMMIHITDVAFIYQNEFLGCTDRLVITPLTDRCYITLAQALGMSMGGAPAGPAGTGKTETTKDMGRCLGKYVVVFNCSDQMDFRGLGRIFKGLAQSGSWGCFDEFNRIDLPVLSVAAQQISIILTCKKEHKKSFIFTDGDNVTMNPEFGLFLTMNPGYAGRQELPENLKINFRSVAMMVPDRQIIIRVKLASCGFIDNVVLARKFFTLYKLCEEQLSKQVHYDFGLRNILSVLRTLGAAKRANPMDTESTIVMRVLRDMNLSKLIDEDEPLFLSLIEDLFPNILLDKAGYPELEAAISRQVEEAGLINHPPWKLKVIQLFETQRVRHGMMTLGPSGAGKTTCIHTLMRAMTDCGKPHREMRMNPKAITAPQMFGRLDVATNDWTDGIFSTLWRKTLRAKKGEHIWIILDGPVDAIWIENLNSVLDDNKTLTLANGDRIPMAPNCKIIFEPHNIDNASPATVSRNGMVFMSSSILDWSPILEGFLKKRSPQEAEILRQLYTESFPDLYRFCIQNLEYKMEVLEAFVITQSINMLQGLIPLKEQGGEVSQAHLGRLFVFALLWSAGAALELDGRRRLELWLRSRPTGTLELPPPAGPGDTAFDYYVAPDGTWTHWNTRTQEYLYPSDTTPEYGSILVPNVDNVRTDFLIQTIAKQGKAVLLIGEQGTAKTVIIKGFMSKYDPECHMIKSLNFSSATTPLMFQRTIESYVDKRMGTTYGPPAGKKMTVFIDDVNMPIINEWGDQVTNEIVRQLMEQNGFYNLEKPGEFTSIVDIQFLAAMIHPGGGRNDIPQRLKRQFSIFNCTLPSEASVDKIFGVIGVGHYCTQRGFSEEVRDSVTKLVPLTRRLWQMTKIKMLPTPAKFHYVFNLRDLSRVWQGMLNTTSEVIKEPNDLLKLWKHECKRVIADRFTVSSDVTWFDKALVSLVEEEFGEEKKLLVDCGIDTYFVDFLRDAPEAAGETSEEADAETPKIYEPIESFSHLKERLNMFLQLYNESIRGAGMDMVFFADAMVHLVKISRVIRTPQGNALLVGVGGSGKQSLTRLASFIAGYVSFQITLTRSYNTSNLMEDLKVLYRTAGQQGKGITFIFTDNEIKDESFLEYMNNVLSSGEVSNLFARDEIDEINSDLASVMKKEFPRCLPTNENLHDYFMSRVRQNLHIVLCFSPVGEKFRNRALKFPALISGCTIDWFSRWPKDALVAVSEHFLTSYDIDCSLEIKKEVVQCMGSFQDGVAEKCVDYFQRFRRSTHVTPKSYLSFIQGYKFIYGEKHVEVRTLANRMNTGLEKLKEASESVAALSKELEAKEKELQVANDKADMVLKEVTMKAQAAEKVKAEVQKVKDRAQAIVDSISKDKAIAEEKLEAAKPALEEAEAALQTIRPSDIATVRTLGRPPHLIMRIMDCVLLLFQRKVSAVKIDLEKSCTMPSWQESLKLMTAGNFLQNLQQFPKDTINEEVIEFLSPYFEMPDYNIETAKRVCGNVAGLCSWTKAMASFFSINKEVLPLKANLVVQENRHLLAMQDLQKAQAELDDKQAELDVVQAEYEQAMTEKQTLLEDAERCRHKMQTASTLISGLAGEKERWTEQSQEFAAQTKRLVGDVLLATAFLSYSGPFNQEFRDLLLNDWRKEMKARKIPFGKNLNLSEMLIDAPTISEWNLQGLPNDDLSIQNGIIVTKASRYPLLIDPQTQGKIWIKNKESRNELQITSLNHKYFRNHLEDSLSLGRPLLIEDVGEELDPALDNVLERNFIKTGSTFKVKVGDKEVDVLDGFRLYITTKLPNPAYTPEISARTSIIDFTVTMKGLEDQLLGRVILTEKQELEKERTHLMEDVTANKRRMKELEDNLLYRLTSTQGSLVEDESLIVVLSNTKRTAEEVTQKLEISAETEVQINSAREEYRPVATRGSILYFLITEMRLVNEMYQTSLRQFLGLFDLSLARSVKSPITSKRIANIIEHMTYEVYKYAARGLYEEHKFLFTLLLTLKIDIQRNRVKHEEFLTLIKGGASLDLKACPPKPSKWILDITWLNLVELSKLRQFSDVLDQISRNEKMWKIWFDKENPEEEPLPNAYDKSLDCFRRLLLIRSWCPDRTIAQARKYIVDSMGEKYAEGVILDLEKTWEESDPRTPLICLLSMGSDPTDSIIALGKRLKIETRYVSMGQGQEVHARKLLQQTMANGGWALLQNCHLGLDFMDELMDIIIETELVHDAFRLWMTTEAHKQFPITLLQMSIKFANDPPQGLRAGLKRTYSGVSQDLLDVSSGSQWKPMLYAVAFLHSTVQERRKFGALGWNIPYEFNQADFNATVQFIQNHLDDMDVKKGVSWTTIRYMIGEIQYGGRVTDDYDKRLLNTFAKVWFSENMFGPDFSFYQGYNIPKCSTVDNYLQYIQSLPAYDSPEVFGLHPNADITYQSKLAKDVLDTILGIQPKDTSGGGDETREAVVARLADDMLEKLPPDYVPFEVKERLQKMGPFQPMNIFLRQEIDRMQRVLSLVRSTLTELKLAIDGTIIMSENLRDALDCMFDARIPAWWKKASWISSTLGFWFTELIERNSQFTSWVFNGRPHCFWMTGFFNPQGFLTAMRQEITRANKGWALDNMVLCNEVTKWMKDDISAPPTEGVYVYGLYLEGAGWDKRNMKLIESKPKVLFELMPVIRIYAENNTLRDPRFYSCPIYKKPVRTDLNYIAAVDLRTAQTPEHWVLRGVALLCDVK

SEQ ID NO: 27352 - protein, 4158 aa, Homo sapiens
  ENSP00000237449
MTFRATDSEFDLTNIEEYAENSALSRLNNIKAKQRVSYVTSTENESDTQILTFRHITKAQEKTRKRQQPIKLEPLPVLKVYQDHKQPEYIHEQNRFQLMTAGIIKRPVSIAKKSFATSSTQFLEHQDAVKKMQIHRPYVEVFSPSPPKLPHTGIGKRGLFGTRSSAYPKYTFHDREEVVKANIRDPLQIIKIIRENEHLGFLYMIPAVPRSSIEYDTYNLKVVSYENINKNDYYTISQRAVTHIYNEDIEFIEIDRWEQEYLYHRELTKIPIFSLFRKWKAFSVWRKNVRSKKITGCQKSLQKNLFIVNPHLRPALLKINELCYHLSFMGLCYIEKCHTYTLQEFKAAQVIRLAEVTERLGEFRNEAKYVVRRACRFALRAAGFVPDDCAFGPFEDYHKVQSSGSFINTPHELPTYGDSEKMTYTEQASKRHYCMRLTCFIRLNDYLIENTMHILTVNAVNSLLNHLTDKLKRTPSADVIQKWITEEKPEVPDKKGTLMVEKQEEDESLIPMFLTELMLTVQSLLFEPSLEDFLDGILGAVNHCQNTVLSVPNLVPDSYFDAFTSPYINNKLEGKTCGTGPSLAAVFEDDKNFHTIISQIKETIQAAFESARIYAATFEKFQIFFKENESLDLQALKLQEPDINFFSEQLEKYHKQHKDAVALRPTRNVGLLLIDTRLLREKLIPSPLRCLEVLNFMLPRQSKKKVDAIIFEAQDAEYKLEFVPTTTTEYVHSLLFLDEIQERIESLEDEGNIVTQMYKLMEQYQVPTPPEDFAVFATMKPSIVAVRNAIDKSVGDRESSIKQFCVHLGSDLEELNNEVNEVKLQAQDPQILDISADQDKIRLILNNLQSVLADLQKRAFQYKSYQKNFKVEVSKFEALEEVSAELKLKQLLWDSFSEWDKLQQEWLKSKFDCLDPEVLNGQVSKYAKFVTQLEKGLPPNSVVPQLKYKVEKMKEKLPVIIDLRNPTLKARHWAAIEQTVDATLVDAEIPLTLERLSQLHVFDFGQEIQDISGQASGEAALEAILKKVEDSWKTTEFVILPHRDSKDVFILGGTDDIQVLLDDSTINVATLASSRYLGPLKTRVDEWQKQLALFNQTLEEWLTCQRNWLYLESIFNAPDIQRQLPAEAKMFLQVDKSWKEIMRKVNRLPNALRAATQPGLLETFQNNNALLDQIQKCLEAYLESKRVIFPRFYFLSNDELLEILAQTRNPQAVQPHLRKCFDSISKLEFALMPPAEGKIPGIDGEPEKVYTNDILAMLSPEGERVSLGKGLKARGNVEEWLGKVEEAMFTSLRRLCKAAIADYQGKLRTDWVVAGHPSQVILTVSQIMWCRDLTECLETEHSNHIQALKNFEKVNFERLNALAAIVQGSLPKLHRNILTALITIDVHARDIVTELVQSKVETVESFDWQRQLRYYWDIDLDNCVARMALSQYTYGYEYLGACPRLVITPLTDRCYLCLMGALQLDLGGAPAGPAGTGKTETTKDLAKALAIQCVVFNCSDGLDYKMMGRFFSGLAQSGAWCCFDEFNRIDIEVLSVIAQQLITIRNAKAAKLSRFMFEGREIKLVMTCAAFITMNPGYAGRTELPDNLKALFRPFAMMVPNYALIAEVILYSEGFESSKILARKMTQMYKLCSEQLSQQDHYDFGMRAVKSVLVMAGSLKRENPDLNEDVVLIRALQDSNLPKFLTDDALLFSGIISDLFPGVQIPEHDYGILQSTIVDVMNRQNLQPEMCMVRKVIQFYETMLVRHGVMLVGPTGGGKTTVYRILAETLGNLQKLGIENSFYQAVKTYVLNPKSITMGELYGEVNNLTLEWKDGLMALSVRAAVNDTSEDHKWIISDGPVDALWIENMNTVLDDNKMLCLANSERIKLTPQIHMLFEVQDLRVASPATVSRCGMVFVDPEELKWMPYVKTWMKGISKKLTEETQEYILNLFQRYVDEGLHFINKKCSQAIPQVDISKVTTLCCLLESLILGKDGVNLAMEQTKLNTILCQTFVFCYLWSLGGNLTENYYDSFDTFIRTQFDDNPDARLPNSGDLWSIHMDFDTKRLDPWERIIPTFKYNRDVPFFEMLVPTTDTVRYGYLMEKLLAVKHSVLFTGITGVGKSVIAKGLLNKIQESAGYVPVYLNFSAQTSSARTQEIIESKLERKRKNILGAPGNKRIVIFVDDLNMPRLDRYGSQPPIELLRQYQDFGGFYDRNKLFWKEIQDVTIISACAPPGGGRNPVTPRFIRHFSMLCLPMPSEHSLKQIFQAILNGFLSDFPPAVKQTASSIVEASVEIYNKMSVDLLPTPAKSHYVFNLRDLSKCVQGILQCDPGTIREEIQIFRLFCHECQRVFHDRLINNEDKHYFHVILTEMANKHFGIAIDLEYFLNKPIIFGDFIKFGADKADRIYDDMPDIEKTANVLQDYLDDYNLTNPKEVKLVFFQDAIEHVSRIARMIRQERGNALLVGVGGTGKQSLTRLAAHICGYKCLQIELSRGYNYDSFHEDLRKLYKMAGVEDKNMVFLFTDTQIVVEEFLEDINNILNSGEVPNLFEKDELEQVLAATRPRAKEVGISEGNRDEVFQYFISKVRQKLHIVLCMSPVGEAFRSRCRMFPSLVNCCTIDWFVQWPREALLSVSKTFFSQVDAGNEELKEKLPLMCVNVHLSVSSMAERYYNELRRRYYTTPTSYLELINLYLSMLSEKRKQIISARDRVKNGLTKLLETNILVDKMKLDLSALEPVLLAKSEDVEALMEKLAVDQESADQVRNTVQEDEATAKVKAEETQAIADDAQRDLDEALPALDAANKALDSLDKADISEIRVFTKPPDLVMTVMEAISILLNAKPDWPSAKQLLGDSNFLKRLLEYDKENIKPQILAKLQKYINNPDFVPEKVEKVSKACKSMCMWVRAMDLYSRVVKVVEPKRQKLRAAQAELDITMATLREKQALLRQVEDQIQALQDEYDKGVNEKESLAKTMALTKARLVRAGKLTAALEDEQVRWEESIQKFEEEISNITGNVFIAAACVAYYGAFTAQYRQSLIECWIQDCQSLEIPIDPSFSLINILGDPYEIRQWNTDGLPRDLISTENGILVTQGRRWPLMIDPQDQANRWIRNKESKSGLKIIKLTDSNFLRILENSIRLGLPVLLEELKETLDPALEPILLKQIFISGGRLLIRLGDSDIDYDKNFRFYMTTKMPNPHYLPEVCIKVTIINFTVTKSGLEDQLLSDVVRLEKPRLEEQRIKLIVRINTDKNQLKTIEEKILRMLFTSEGNILDNEELIDTLQDSKITSGAIKTRLEEAESTEQMINVAREKYRPVATQGSVMYFVIASLSEIDPMYQYSLKYFKQLFNTTIETSVKTENLQQRLDVLLEQTLLTAYVNVSRGLFEQHKLIYSFMLCVEMMRQQGTLSDAEWNFFLRGSAGLEKERPPKPEAPWLPTATWFACCDLEESFPVFHGLTQNILSHPISIRLGSFETYINPQKWEGYSKMKHEDKHMRQEKEAAHQDPWSAGLSSFHKLILIKCCKEEKVVFALTDFVIENLGKQFIETPPVDLPTLYQDMSCNTPLVFILSTGSDPMGAFQRFARESGYSERVQSISLGQGQGPIAEKMVKDAMKSGNWVFLQNCHLAVSWMLAMEELIKTFTDPDSAIKDTFRLFLSSMPSNTFPVTVLQNSVKVTNEPPKGLRANIRRAFTEMTPSFFEENILGKKWRQIIFGICFFHAIIQERKKFGPLGWNICYEFNDSDRECALLNLKLYCKEGKIPWDALIYITGEITYGGRVTDSWDQRCLRTILKRFFSPETLEEDYKYSESGIYFAPMADSLQEFKDYIENLPLIDDPEIFGMHENANLVFQYKETSTLINTILEVQPRSSTGGEGKSNDEIVQELVASVQTRVPEKLEMEGASESLFVKDLQGRLNSLTTVLGQEVDRFNNLLKLIHTSLETLNKAIAGFVVMSEEMEKVYNSFLNNQVPALWSNTAYPSLKPLGSWVKDLILRTSFVDLWLKRGQPKSYWISGFFFPQGFLTGTLQNHARKYNLPIDELSFKYSVIPTYRDQAAVIEAAKTVQFGQELPMDMELPSPEDGVLVHGMFMDASRWDDKEMVIEDALPGQMNPVLPVVHFEPQQNYKPSPTLYHCPLYKTGARAGTLSTTGHSTNFVVTVLLPSKRSKDYWIAKGSALLCQLSE

SEQ ID NO: 27353 - protein, 4158 aa, Homo sapiens; identical to SEQ ID NO: 27352
  ENSP00000374045

SEQ ID NO: 27354 - protein, 397 aa, Homo sapiens
  ENSP00000369127
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 27355 - protein, 426 aa, Homo sapiens
  ENSP00000378324
MARGGSQSWSSGESDGQPKEQTPEKPRHKMVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 27356 - protein, 139 aa, Homo sapiens
  ENSP00000438263
MARGGSQSWSSGESDGQPKEQTPEKPRHKMVKETQYYDILGVKPSASPEEIKKAYRKLALKYHPDKNPDEGEKGHGHLQPDISLYSYSGFSVTSDTQLIISTNHRLKMLCILETEVKSFSILFTESLLFISKEAHDPPE

SEQ ID NO: 27357 - protein, 211 aa, Homo sapiens
  ENSP00000395191
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEV

SEQ ID NO: 27358 - protein, 114 aa, Homo sapiens
  ENSP00000407136
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRECCTPVICNS

SEQ ID NO: 27359 - protein, 219 aa, Homo sapiens
  ENSP00000443962
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKETRP

SEQ ID NO: 27360 - protein, 397 aa, Homo sapiens
  ENSP00000339581
MVKETQYYDILGVKPSASPEEIKKAYRKLALKYHPDKNPDEGEKFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 27361 - protein, 397 aa, Homo sapiens; identical to SEQ ID NO: 27360
  ENSP00000378321

SEQ ID NO: 27362 - protein, 53 aa, Homo sapiens
  ENSP00000441946
MVKETQYYDILGVKPSASPEEIKKAYRKLALKYHPDKNPDEGEKARMLYTSYL

SEQ ID NO: 27363 - protein, 370 aa, Homo sapiens
  ENSP00000413499
MWESLTLDSGQISALTRFKLISQAYEVLSDPKKRDVYDQGGEQAIKEGGSGSPSFSSPMDIFDMFFGGGGRMARERRGKNVVHQLSVTLEDLYNGVTKKLALQKNVICEKCEGVGGKKGSVEKCPLCKGRGMQIHIQQIGPGMVQQIQTVCIECKGQGERINPKDRCESCSGAKVIREKKIIEVHVEKGMKDGQKILFHGEGDQEPELEPGDVIIVLDQKDHSVFQRRGHDLIMKMKIQLSEALCGFKKTIKTLDNRILVITSKAGEVIKHGDLRCVRDEGMPIYKAPLEKGILIIQFLVIFPEKHWLSLEKLPQLEALLPPRQKVRITDDMDQVELKEFCPNEQNWRQHREAYEEDEDGPQAGVQCQTA

SEQ ID NO: 27364 - protein, 340 aa, Homo sapiens
  ENSP00000254322
MGKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 27365 - protein, 240 aa, Homo sapiens
  ENSP00000444212
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPVVFKDVIRPGMRRKVPGEGLPLPKTPEKRGDLIIEFEVIFPERIPQTSRTVLEQVLPI

SEQ ID NO: 27366 - protein, 183 aa, Homo sapiens
  ENSP00000471073
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSNNIPADIVFVLKDKPHNIFKRDGSDVIYPARISLREALCGCTVNVPTLDGRTIPV

SEQ ID NO: 27367 - protein, 162 aa, Homo sapiens
  ENSP00000469221
MLMCLKGSGPSGGSGGGANGTSFSYTFHGDPHAMFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGTKITFPKEGDQTSN

SEQ ID NO: 27368 - protein, 116 aa, Homo sapiens
  ENSP00000470063
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIEVKKGWKEGT

SEQ ID NO: 27369 - protein, 116 aa, Homo sapiens; identical to SEQ ID NO: 27368
  ENSP00000470596

SEQ ID NO: 27370 - protein, 107 aa, Homo sapiens
  ENSP00000470460
MFAEFFGGRNPFDTFFGQRNGEEGMDIDDPFSGFPMGMGGFTNVNFGRSRSAQEPARKKQDPPVTHDLRVSLEEIYSGCTKKMKISHKRLNPDGKSIRNEDKILTIE

SEQ ID NO: 27371 - protein, 91 aa, Homo sapiens
  ENSP00000471798
MFAEFFGGRNPFDTFFGQRNGEEGMDIDDPFSGFPMGMGGFTNVNFGRSRSAQEPARKKQDPPVTHDLRVSLEEIYSGCTKKMKISHKRLN

SEQ ID NO: 27372 - protein, 80 aa, Homo sapiens
  ENSP00000472886
MFAEFFGGRNPFDTFFGQRNGEEGMDIDDPFSGFPMGMGGFTNVNFGRSRSAQEPARKKQDPPVTHDLRVSLEEIYSGCT

SEQ ID NO: 27373 - protein, 79 aa, Homo sapiens
  ENSP00000471603
MFAEFFGGRNPFDTFFGQRNGEEGMDIDDPFSGFPMGMGGFTNVNFGRSRSAQEPARKKQDPPVTHDLRVSLEEIYSGC

SEQ ID NO: 27374 - protein, 172 aa, Homo sapiens
  ENSP00000399494
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIY

SEQ ID NO: 27375 - protein, 337 aa, Homo sapiens
  ENSP00000359799
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 27376 - protein, 420 aa, Homo sapiens
  ENSP00000413684
MFKRTVLSCPPPAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 27377 - protein, 348 aa, Homo sapiens
  ENSP00000441999
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 27378 - protein, 211 aa, Homo sapiens
  ENSP00000445536
MYGPRAASRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMK

SEQ ID NO: 27379 - protein, 155 aa, Homo sapiens
  ENSP00000396332
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRR

SEQ ID NO: 27380 - protein, 205 aa, Homo sapiens
  ENSP00000439217
MGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVR

SEQ ID NO: 27381 - protein, 105 aa, Homo sapiens
  ENSP00000433640
MGKDYYKILGIPSGANEDEIKKAYRKMALKYHPDKNKEPNAEEKFKEIAEAYDVLSDPKKRGLYDQYGEEAAAPLGPSVALTQMTWMWMKMRTHLALSAVLASMG

SEQ ID NO: 27382 - protein, 33 aa, Homo sapiens
  ENSP00000393749
MGKDYYKILGIPSGANEDEIKKAYRKMALKYHP

SEQ ID NO: 27383 - protein, 348 aa, Homo sapiens; identical to SEQ ID NO: 27377
  ENSP00000312517

SEQ ID NO: 27384 - protein, 462 aa, Homo sapiens
  ENSP00000404079
MGGAEAEPWGRAPGPAIGGRRAGDSCPGWRRRSRSRGRGQRLSHGPRRRPQLLTAAPPLQARGAFRSFPHSWGEDFLASLMFKIQLEPLKLRAWTLNGFVKFRNKETSAGPVAVMGKDYYKILGIPSGANEDEIKKAYRKMALKYHPDKNKEPNAEEKFKEIAEAYDVLSDPKKRGLYDQYGEEGLKTGGGTSGGSSGSFHYTFHGDPHATFASFFGGSNPFDIFFASSRSTRPFSGFDPDDMDVDEDEDPFGAFGRFGFNGLSRGPRRAPEPLYPRRKVQDPPVVHELRVSLEEIYHGSTKRMKITRRRLNPDGRTVRTEDKILHIVIKRGWKEGTKITFPKEGDATPDNIPADIVFVLKDKPHAHFRRDGTNVLYSALISLKEALCGCTVNIPTIDGRVIPLPCNDVIKPGTVKRLRGEGLPFPKVPTQRGDLIVEFKVRFPDRLTPQTRQILKQHLPCS

SEQ ID NO: 27385 - protein, 145 aa, Homo sapiens
  ENSP00000410643
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFS

SEQ ID NO: 27386 - protein, 241 aa, Homo sapiens
  ENSP00000397556
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGKEQLLRLDNK

SEQ ID NO: 27387 - protein, 326 aa, Homo sapiens
  ENSP00000262177
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 27388 - protein, 228 aa, Homo sapiens
  ENSP00000400665
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLT

SEQ ID NO: 27389 - protein, 334 aa, Homo sapiens
  ENSP00000488263
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGNRRGPRGSRSRGTGSFFSAFSGFPSFGSGFSSFDTGFTSFGSLGHGGLTSFSSTSFGGSGMGNFKSISTSTKMVNGRKITTKRIVENGQERVEVEEDGQLKSLTINGVADDDALAEERMRRGQNALPAQPAGLRPPKPPRPASLLRHAPHCLSEEEGEQDRPRAPGPWDPLASAAGVQREAAVEQAQSETSLGARGQRGHKPRLGCCVLT

SEQ ID NO: 27390 - protein, 211 aa, Homo sapiens
  ENSP00000396267
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGVADDDALAEERMRRGQNALPAQPAGLRPPKPPRPASLLRHAPHCLSEEEGEQDRPRAPGPWDPLASAAGLKEGGKRKKQKQREESKKKKSTKGNH

SEQ ID NO: 27391 - protein, 129 aa, Homo sapiens
  ENSP00000415201
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFGQGSVWVEVLCSDR

SEQ ID NO: 27392 - protein, 66 aa, Homo sapiens
  ENSP00000391690
MVDYYEVLGVQRHASPEDIKKAYRKLALKWHPDKNPENKEEAERKFKQVAEAYEVLSDAKKRDIYD

SEQ ID NO: 27393 - protein, 125 aa, Homo sapiens
  ENSP00000403407
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDDVFREFFGGRDPFSFDFFEDPFEDFFGN

SEQ ID NO: 27394 - protein, 98 aa, Homo sapiens
  ENSP00000396240
MVDYYEVLGVQRHASPEDIKKAYRKLALKWHPDKNPENKEEAERKFKQVAEAYEVLSDAKKRDIYDKYGKEGLNGGGGGGSHFDSPFEFGFTFRNPDD

SEQ ID NO: 27395 - protein, 45 aa, Homo sapiens
  ENSP00000389599
MVDYYEVLGVQRHASPEDIKKAYRKLALKWHPDKNPENKEEAERK

SEQ ID NO: 27396 - protein, 334 aa, Homo sapiens; identical to SEQ ID NO: 27389
  ENSP00000488740

SEQ ID NO: 27397 - protein, 273 aa, Homo sapiens
  ENSP00000264711
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQTFYISIVDLCENGGKRPTTNSSASFTKEQADAIRRIRNSKDSWDMLGVKPGASRDEVNKAYRKLAVLLHPDKCVAPGSEDAFKAVVNARTALLKNIK

SEQ ID NO: 27398 - protein, 90 aa, Homo sapiens
  ENSP00000370187
MEANMPKRKEPGRSLRIKVISMGNAEVGKSCIIKRYCEKRFVSKYLATIGIDYGVTKVHVRDREIKVNIFDMAGHPFFYEMRKLRRREVK

SEQ ID NO: 27399 - protein, 177 aa, Homo sapiens
  ENSP00000440086
MEANMPKRKEPGRSLRIKVISMGNAEVGKSCIIKRYCEKRFVSKYLATIGIDYGVTKVHVRDREIKVNIFDMAGHPFFYEVRNEFYKDTQGVILVYDVGQKDSFDALDAWLAEMKQELGPHGNMENIIFVVCANKIDCTKHRCVDESEGRLWAESKGFLYFETSAQTGEGINEMFQG

SEQ ID NO: 27400 - protein, 494 aa, Homo sapiens
  ENSP00000406463
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 27401 - protein, 55 aa, Homo sapiens
  ENSP00000467702
DKNASEDEIKKAYRKRALMHHPDFDPNNIFKAFFGGPGGFSFEASGPGNFFFQFG

SEQ ID NO: 27402 - protein, 438 aa, Homo sapiens
  ENSP00000394327
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKLRKLDDAIEDCTNAVKLDDTYIKAYLRRAQCYMDTEQYEEAVRDYEKVYQTEKTKEHKQLLKNAQLELKKSKRKDYYKILGVDKNASEDEIKKAYRKRALMHHPDRHSGASAEVQKEEEKKFKEVGEAFTILSDPKKKTRYDSGQDLDEEGMNMGDFDPNNIFKAFFGGPGGFSFEASGPGNFFFQFG

SEQ ID NO: 27403 - protein, 137 aa, Homo sapiens
  ENSP00000466114
MAAAAECDVVMAATEPELLDDQEAKREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQELH

SEQ ID NO: 27404 - protein, 438 aa, Homo sapiens; identical to SEQ ID NO: 27402
  ENSP00000313311

SEQ ID NO: 27405 - protein, 89 aa, Homo sapiens
  ENSP00000464993
  MOD_RES (1)..(1): Any amino acid
XKEDGNKAFKEGNYKLAYELYTEALGIDPNNIKTNAKLYCNRGTVNSKLRKLDDAIEDCTNAVKLDDTYIKAYLRRAQWWDCSSPRLSL

SEQ ID NO: 27406 - protein, 253 aa, Homo sapiens
  ENSP00000467477
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKLYCNRGTVNSKETR

SEQ ID NO: 27407 - protein, 258 aa, Homo sapiens
  ENSP00000468805
MAAAAECDVVMAATEPELLDDQEAKREAETFKEQGNAYYAKKDYNEAYNYYTKAIDMCPKNASYYGNRAATLMMLGRFREALGDAQQSVRLDDSFVRFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKLAYELYTEALGIDPNNIKTNAKL

SEQ ID NO: 27408 - protein, 261 aa, Homo sapiens
  ENSP00000464756
MSIGTCCFPGTNREAETFKEQGNAYYAKKDYNEAYNYYTKAIDMCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAECLAMLGRYPEAQSVASDILRMDSTNADALYVRGLCLYYEDCIEKAVQFFVQALRMAPDHEKACIACRNAKALKAKKEDGNKAFKEGNYKL

SEQ ID NO: 27409 - protein, 128 aa, Homo sapiens
  ENSP00000468102
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRALEFAPACHRFKILKAE

SEQ ID NO: 27410 - protein, 113 aa, Homo sapiens
  ENSP00000465340
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRKVVFCMDRAL

SEQ ID NO: 27411 - protein, 104 aa, Homo sapiens
  ENSP00000466748
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDFRK

SEQ ID NO: 27412 - protein, 39 aa, Homo sapiens
  ENSP00000466877
MAAAAECDVVMAATEPELLDDQEAKSPTPLTSHPSVPLL

SEQ ID NO: 27413 - protein, 102 aa, Homo sapiens
  ENSP00000465228
MCPKNASYYGNRAATLMMLGRFREALGDAQQSVRLDDSFVRGHLREGKCHLSLGNAMAACRSFQRALELDHKNAQAQQEFKNANAVMEYEKIAETDFEKRDF

SEQ ID NO: 27414 - protein, 75 aa, Homo sapiens
  ENSP00000465399
MCPKNASYYGNRAATLMMLGRFREALGDAQQSVRLDDSFVRGHLREGKCHLSLGNAMAACRSFQRALELDHKNAQ

SEQ ID NO: 27415 - protein, 74 aa, Homo sapiens
  ENSP00000465140
MCPKNASYYGNRAATLMMLGRFREALGDAQQSVRLDDSFVRGHLREGKCHLSLGNAMAACRSFQRALELDHKNA

SEQ ID NO: 27416 - protein, 737 aa, Homo sapiens
  ENSP00000345229
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 27417 - protein, 865 aa, Homo sapiens
  ENSP00000443657
MPTLFKGVWGVVEHSRALGRFCPACLPSGPHLHTQPALGTAEMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 27418 - protein, 1209 aa, Homo sapiens
  ENSP00000489875
MCETQKARKEREVEEKRHWDSSWEYEDYGSVRKRNLTVLDGLYRENDLDPRYWAKGQHQPYRKRDCGYWDFEQSEPSYMDCGEAHESGKGCVYHGGHDGYRSPENVDYESLSPGTKDNSPTRSPDVTSKAGGYGEANGYSDCKNLNYNPEDSKKAEQLTDCRGLDDSSANLGQPQLWYIDHENVNHNLEDCWATNFYCREHSNLYHVPGSYPDGQPVSFSDSNGVNEDKEFIKYHEGDRNVHQNDNMYPKAKTHIMDQGDFDTENKGYDALFANCAYKSRNSRGTDSLHQMENLEYNGTDIPRTKAHGGSRILLDGLQTQCTRGEQGGHHLGIPQSSSLEKNIWHLEEEKKLNGPETWRRNSCLRRTAPSTLRRSEFVQNSKKTQEMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 27419 - protein, 1577 aa, Homo sapiens
  ENSP00000315659
MEAGSVVRAIFDFCPSVSEELPLFVGDIIEVLAVVDEFWLLGKKEDVTGQFPSSFVEIVTIPSLKEGERLFVCICEFTSQELDNLPLHRGDLVILDGIPTAGWLQGRSCWGARGFFPSSCVRELCLSSQSRQWHSQSALFQIPEYSMGQARALMGLSAQLDEELDFREGDVITIIGVPEPGWFEGELEGRRGIFPEGFVELLGPLRTVDESVSSGNQDDCIVNGEVDTPVGEEEIGPDEDEEEPGTYGVALYRFQALEPNELDFEVGDKIRILATLEDGWLEGSLKGRTGIFPYRFVKLCPDTRVEETMALPQEGSLARIPETSLDCLENTLGVEEQRHETSDHEAEEPDCIISEAPTSPLGHLTSEYDTDRNSYQDEDTAGGPPRSPGVEWEMPLATDSPTSDPTEVVNGISSQPQVPFHPNLQKSQYYSTVGGSHPHSEQYPDLLPLEARTRDYASLPPKRMYSQLKTLQKPVLPLYRGSSVSASRVVKPRQSSPQLHNLASYTKKHHTSSVYSISERLEMKPGPQAQGLVMEAATHSQGDGSTDLDSKLTQQLIEFEKSLAGPGTEPDKILRHFSIMDFNSEKDIVRGSSKLITEQELPERRKALRPPPPRPCTPVSTSPHLLVDQNLKPAPPLVVRPSRPAPLPPSAQQRTNAVSPKLLSRHRPTCETLEKEGPGHMGRSLDQTSPCPLVLVRIEEMERDLDMYSRAQEELNLMLEEKQDESSRAETLEDLKFCESNIESLNMELQQLREMTLLSSQSSSLVAPSGSVSAENPEQRMLEKRAKVIEELLQTERDYIRDLEMCIERIMVPMQQAQVPNIDFEGLFGNMQMVIKVSKQLLAALEISDAVGPVFLGHRDELEGTYKIYCQNHDEAIALLEIYEKDEKIQKHLQDSLADLKSLYNEWGCTNYINLGSFLIKPVQRVMRYPLLLMELLNSTPESHPDKVPLTNAVLAVKEINVNINEYKRRKDLVLKYRKGDEDSLMEKISKLNIHSIIKKSNRVSSHLKHLTGFAPQIKDEVFEETEKNFRMQERLIKSFIRDLSLYLQHIRESACVKVVAAVSMWDVCMERGHRDLEQFERVHRYISDQLFTNFKERTERLVISPLNQLLSMFTGPHKLVQKRFDKLLDFYNCTERAEKLKDKKTLEELQSARNNYEALNAQLLDELPKFHQYAQGLFTNCVHGYAEAHCDFVHQALEQLKPLLSLLKVAGREGNLIAIFHEEHSRVLQQLQVFTFFPESLPATKKPFERKTIDRQSARKPLLGLPSYMLQSEELRASLLARYPPEKLFQAERNFNAAQDLDVSLLEGDLVGVIKKKDPMGSQNRWLIDNGVTKGFVYSSFLKPYNPRRSHSDASVGSHSSTESEHGSSSPRFPRQNSGSTLTFNPSSMAVSFTSGSCQKQPQDASPPPKECDQGTLSASLNPSNSESSPSRCPSDPDSTSQPRSGDSADVARDVKQPTATPRSYRNFRHPEIVGYSVPGRNGQSQDLVKGCARTAQAPEDRSTEPDGSEAEGNQVYFAVYTFKARNPNELSVSANQKLKILEFKDVTGNTEWWLAEVNGKKGYVPSNYIRKTEYT

SEQ ID NO: 27420 - protein, 412 aa, Homo sapiens
  ENSP00000417238
MTLRRRGEKATISIQEHMAIDVCPGPTRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKANKLRTKTLRNTLNPTWNETLTYYGITDEDMIRKTLRISVCDEDKFRHNEFIGETRVPLKKLKPNHTKTFSICLEKQLPVDKTEDKSLEERGRILISLKYSSQKQGLLVGIVRCAHLAAMDANGYSDPYVKTYLRPDVDKKSKHKTAVKKKTLNPEFNEEFCYEIKHGDLAKKSLEVTVWDYDIGKSNDFIGGVVLGIHAKGERLKHWFDCLKNKDKRIERWHTLTSELPGAVLSD

SEQ ID NO: 27421 - protein, 412 aa, Homo sapiens
  ENSP00000482950
MTLRRRGEKATISIQEHMAIDVCPGPIRPIKQISDYFPRFPRGLPPDAGPRAAAPPDAPARPAVAGAGRRSPSDGAREDDEDVDQLFGAYGSSPGPSPGPSPARPPAKPPEDEPDADGYESDDCTALGTLDFSLLYDQENNALHCTITKAKGLKPMDHNGLADPYVKLHLLPGASKANKLRTKTLRNTLNPTWNETLTYYGITDEDMIRKTLRISVCDEDKFRHNEFIGETRVPLKKLKPNHTKTFSICLEKQLPVDKTEDKSLEERGRILISLKYSSQKQGLLVGIVRCAHLAAMDANGYSDPYVKTYLRPDVDKKSKHKTAVKKKTLNPEFNEEFCYEIKHGDLAKKSLEVTVWDYDIGKSNDFIGGVVLGIHAKGERLKHWFDCLKNKDKRIERWHTLTSELPGAVLSD

SEQ ID NO: 27422 - protein, 1865 aa, Homo sapiens
  ENSP00000280333
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQASVDSGIVQ

SEQ ID NO: 27423 - protein, 1886 aa, Homo sapiens
  ENSP00000485033
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPLALDDAIRHKPLNMSSRFSPRVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQASVDSGIVQ

SEQ ID NO: 27424 - protein, 83 aa, Homo sapiens
  ENSP00000387036
MARWIPTKRQKYGVAIYNYNASQDVELSLQIGDTVHILEMYEGWYRGYTLQNKSKKAIGSRTPTIPKSMDAQVSDIKWHSICI

SEQ ID NO: 27425 - protein, 350 aa, Homo sapiens
  ENSP00000429737
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQ

SEQ ID NO: 27426 - protein, 1870 aa, Homo sapiens
  ENSP00000276440
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQWSDKPCVPHLLQKDSYYVYTQQELKEKLYQEIISYFDKGKMWEKAIKLSKELAETYESKVFDYEGLGNLLKKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFATMWIERTTYTTAYTFPGILKWFEVKQISTEEISPLENAIETMELTNERISNCVQQHAWDRSLSVHPLSMLLSGIVDPAVMGGFSNYEKAFFTEKYLQEHPEDQEKVELLKRLIALQMPLLTEGIRIHGEKLTEQLKPLHERLSSCFRELKEKVEKHYGVITLPPNLTERKQSRTGSIVLPYIMSSTLRRLSITSVTSSVVSTSSNSSDNAPSRPGSDGSILEPLLERRASSGARVEDLSLREENSENRISKFKRKDWSLSKSQVIAEKAPEPDLMSPTRKAQRPKSLQLMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 27427 - protein, 1090 aa, Homo sapiens
  ENSP00000414125
  MOD_RES (1)..(1): Any amino acid
XVNPAEPRFAGPVHLQYHPHLWPLCELQELCLQHRGRCRVVYGPLRPRPVHFYQDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQVNGSESLFQQGGVQCPFRLNSIHFMILMGKNFIPGISFYTSFFSSF

SEQ ID NO: 27428 - protein, 138 aa, Homo sapiens
  ENSP00000428479
  MOD_RES (1)..(1): Any amino acid
XMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYV

SEQ ID NO: 27429 - protein, 2047 aa, Homo sapiens
  ENSP00000294618
MAASERRAFAHKINRTVAAEVRKQVSRERSGSPHSSRRCSSSLGVPLTEVVEPLDFEDVLLSRPPDAEPGPLRDLVEFPADDLELLLQPRECRTTEPGIPKDEKLDAQVRAAVEMYIEDWVIVHRRYQYLSAAYSPVTTDTQRERQKGLPRQVFEQDASGDERSGPEDSNDSRRGSGSPEDTPRSSGASSIFDLRNLAADSLLPSLLERAAPEDVDRRNETLRRQHRPPALLTLYPAPDEDEAVERCSRPEPPREHFGQRILVKCLSLKFEIEIEPIFGILALYDVREKKKISENFYFDLNSDSMKGLLRAHGTHPAISTLARSAIFSVTYPSPDIFLVIKLEKVLQQGDISECCEPYMVLKEVDTAKNKEKLEKLRLAAEQFCTRLGRYRMPFAWTAVHLANIVSSAGQLDRDSDSEGERRPAWTDRRRRGPQDRASSGDDACSFSGFRPATLTVTNFFKQEAERLSDEDLFKFLADMRRPSSLLRRLRPVTAQLKIDISPAPENPHFCLSPELLHIKPYPDPRGRPTKEILEFPAREVYAPHTSYRNLLYVYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 27430 - protein, 98 aa, Homo sapiens
  ENSP00000468291
RKTLLSTDHAFPYIKTRIRVCHREEELLEQSKFPKGRPLSPQGPKLYLEEPAPGPQLSVLRGESALVPTGLWGDHTVLGAGPSAPVSPSVCTDASSLF

SEQ ID NO: 27431 - protein, 1336 aa, Homo sapiens
  ENSP00000468638
  MOD_RES (1)..(1): Any amino acid
XLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKGIDRSHSWVNSAYAPGGSKAVLRRAPPYCGADPRQLLHEELALQWVVSSSAVREAILQHAWFFFQLMVKSMALHLLLGQRLDTPRKLRFPGRFLDDITALVGSVGLEVITRVHKDVELAEHLNASLAFFLSDLLSLVDRGFVFSLVRAHYKQVATRLQSSPNPAALLTLRMEFTRILCSHEHYVTLNLPCCPLSPPASPSPSVSSTTSQSSTFSSQAPDPKVTSMFELSGPFRQQHFLAGLLLTELALALEPEAEGAFLLHKKAISAVHSLLCGHDTDPRYAEATVKARVAELYLPLLSIARDTLPRLHDFAEGPGQRSRLASMLDSDTEGEGDIAGTINPSVAMAIAGGPLAPGSRASISQGPPTASRAGCALSAESSRTLLACVLWVLKNTEPALLQRWATDLTLPQLGRLLDLLYLCLAAFEYKGKKAFERINSLTFKKSLDMKARLEEAILGTIGARQEMVRRSRERSPFGNPENVRWRKSVTHWKQTSDRVDKTKDEMEHEALVEGNLATEASLVVLDTLEIIVQTVMLSEARESVLGAVLKVVLYSLGSAQSALFLQHGLATQRALVSKFPELLFEEDTELCADLCLRLLRHCGSRISTIRTHASASLYLLMRQNFEIGHNFARVKMQVTMSLSSLVGTTQNFSEEHLRRSLKTILTYAEEDMGLRDSTFAEQVQDLMFNLHMILTDTVKMKEHQEDPEMLIDLMYRIARGYQGSPDLRLTWLQNMAGKHAELGNHAEAAQCMVHAAALVAEYLALLEDHRHLPVGCVSFQNISSNVLEESAISDDILSPDEEGFCSGKHFTELGLVGLLEQAAGYFTMGGLYEAVNEVYKNLIPILEAHRDYKKLAAVHGKLQEAFTKIMHQSSGWERVFGTYFRVGFYGAHFGDLDEQEFVYKEPSITKLAEISHRLEEFYTERFGDDVVEIIKDSNPVDKSKLDSQKAYIQITYVEPYFDTYELKDRVTYFDRNYGLRTFLFCTPFTPDGRAHGELPEQHKRKTLLSTDHAFPYIKTRIRVCHREETVLTPVEVAIEDMQKKTRELAFATEQDPPDAKMLQMVLQGSVGPTVNQGPLEVAQVFLAEIPEDPKLFRHHNKLRLCFKDFCKKCEDALRKNKALIGPDQKEYHRELERNYCRLREALQPLLTQRLPQLMAPTPPGLRNSLNRASFRKADL

SEQ ID NO: 27432 - protein, 148 aa, Homo sapiens
  ENSP00000467231
  MOD_RES (1)..(1): Any amino acid
XRHLPVGCVSFQNISSNVLEESAISDDILSPDEEGFCSGKHFTELGLVGLLEQAAGYFTMPQRVFGTYFRVGFYGAHFGDLDEQEFVYKEPSITKLAEISHRLEEFYTERFGDDVVEIIKDSNPVDKSKLDSQKAYIQITYVEPYFDT

SEQ ID NO: 27433 - protein, 464 aa, Homo sapiens
  ENSP00000467191
  MOD_RES (1)..(1): Any amino acid
XYPHSLNFSSRQGSVRNLAVRVQYMTGEDPSQALPVIFGKSSCSEFTREAFTPVVYHNKSPEFYEEFKLHLPACVTENHHLLFTFYHVSCQPRPGTALETPVGFTWIPLLQHGRLRTGPFCLPVSVDQPPPSYSVLTPDVALPGMRWVDGHKGVFSVELTAVSSVHPQDPYLDKFFTLVHVLEEGAFPFRLKDTVLSEGNVEQELRASLAALRLASPEPLVAFSHHVLDKLVRLVIRPPIISGQIVNLGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKAIDCNSSRASSYLEGSSSAPPATQLRPTVQKLLHEELALQWVVSSSAVREAILQHAWFFFQLMVKSMALHLLLGQRLDTPRKLRFPGRFLDDITALVGSVGLEVITRVHK

SEQ ID NO: 27434 - protein, 184 aa, Homo sapiens
  ENSP00000465767
LGRGAFEAMAHVVSLVHRSLEAAQDARGHCPQLAAYVHYAFRLPGTEPSLPDGAPPVTVQAATLARGSGRPASLYLARSKSISSSNPDLAVAPGSVDDEVSRILASKGIDRSHSWVNSAYAPGGSKAVLRRAPPYCGADPRQAIDCNSSRASSYLEGSSSAPPATQLRPTVQKLLHEELALQWV

SEQ ID NO: 27435 - protein, 2131 aa, Homo sapiens
  ENSP00000251157
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27436 - protein, 2129 aa, Homo sapiens
  ENSP00000413583
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27437 - protein, 2109 aa, Homo sapiens
  ENSP00000340742
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27438 - protein, 1229 aa, Homo sapiens
  ENSP00000490888
DEVRSIIGSKGLDRSNSWVNTGGPKAAPWGSNPSPSAESTQAMDRSCNRMSSHTETSSFLQTLTGRLPTKKGKEDELEKLSLLLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27439 - protein, 2100 aa, Homo sapiens
  ENSP00000489284
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27440 - protein, 2098 aa, Homo sapiens
  ENSP00000489499
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQDGKRMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27441 - protein, 2140 aa, Homo sapiens
  ENSP00000489124
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVIFGKSSCSEFSKEAYTAVVYHNRSPDFHEEIKVKLPATLTDHHHLLFTFYHVSCQQKQNTPLETPVGYTWIPMLQNGRLKTGQFCLPVSLEKPPQAYSVLSPEVPLPGMKWVDNHKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQAMDRSCNRMSSHTETSSFLQTLTGRLPTKKLFHEELALQWVVCSGSVRESALQQAWFFFELMVKSMVHHLYFNDKLEAPRKSRFPERFMDDIAALVSTIASDIVSRFQKDTEMVERLNTSLAFFLNDLLSVMDRGFVFSLIKSCYKQVSSKLYSLPNPSVLVSLRLDFLRIICSHEHYVTLNLPCSLLTPPASPSPSVSSATSQSSGFSTNVQDQKIANMFELSVPFRQQHYLAGLVLTELAVILDPDAEGLFGLHKKVINMVHNLLSSHDSDPRYSDPQIKARVAMLYLPLIGIIMETVPQLYDFTETHNQRGRPICIATDDYESESGSMISQTVAMAIAGTSVPQLTRPGSFLLTSTSGRQHTTFSAESSRSLLICLLWVLKNADETVLQKWFTDLSVLQLNRLLDLLYLCVSCFEYKGKKVFERMNSLTFKKSKDMRAKLEEAILGSIGARQEMVRRSRGQLGTYTIASPPERSPSGSAFGSQENLRWRKDMTHWRQNTEKLDKSRAEIEHEALIDGNLATEANLIILDTLEIVVQTVSVTESKESILGGVLKVLLHSMACNQSAVYLQHCFATQRALVSKFPELLFEEETEQCADLCLRLLRHCSSSIGTIRSHASASLYLLMRQNFEIGNNFARVKMQVTMSLSSLVGTSQNFNEEFLRRSLKTILTYAEEDLELRETTFPDQVQDLVFNLHMILSDTVKMKEHQEDPEMLIDLMYRIAKGYQTSPDLRLTWLQNMAGKHSERSNHAEAAQCLVHSAALVAEYLSMLEDRKYLPVGCVTFQNISSNVLEESAVSDDVVSPDEEGICSGKYFTESGLVGLLEQAAASFSMAGMYEAVNEVYKVLIPIHEANRDAKKLSTIHGKLQEAFSKIVHQSTGWERMFGTYFRVGFYGTKFGDLDEQEFVYKEPAITKLAEISHRLEGFYGERFGEDVVEVIKDSNPVDKCKLDPNKAYIQITYVEPYFDTYEMKDRITYFDKNYNLRRFMYCTPFTLDGRAHGELHEQFKRKTILTTSHAFPYIKTRVNVTHKEEIILTPIEVAIEDMQKKTQELAFATHQDPADPKMLQMVLQGSVGTTVNQGPLEVAQVFLSEIPSDPKLFRHHNKLRLCFKDFTKRCEDALRKNKSLIGPDQKEYQRELERNYHRLKEALQPLINRKIPQLYKAVLPVTCHRDSFSRMSLRKMDL

SEQ ID NO: 27442 - protein, 101 aa, Homo sapiens
  ENSP00000489412
FTESGLVGLLEQAAASFSMAGMYEAVNEVYKVLIPIHEANRDAKKLSTIHGKLQEAFSKIVHQFFYDLPFFTFYYTEYWLGADVWHLFSCWFLWNQVRGFG

SEQ ID NO: 27443 - protein, 602 aa, Homo sapiens
  ENSP00000490079
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPVS

SEQ ID NO: 27444 - protein, 255 aa, Homo sapiens
  ENSP00000489037
  MOD_RES (1)..(1): Any amino acid
XKGVFNVEVVAVSSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKLFHEELALQWVVCSGSVRESALQQAWFFFELMVKSMVHHLYFNDKLEA

SEQ ID NO: 27445 - protein, 248 aa, Homo sapiens
  ENSP00000489450
SSIHTQDPYLDKFFALVNALDEHLFPVRIGDMRIMENNLENELKSSISALNSSQLEPVVRFLHLLLDKLILLVIRPPVIAGQIVNLGQASFEAMASIINRLHKNLEGNHDQHGRNSLLASYIHYVFRLPNTYPNSSSPGPGGLGGSVHYATMARSAVRPASLNLNRSRSLSNSNPDISGTPTSPDDEVRSIIGSKGLDRSNSWVNTGGPKAAPWGSNPSPSAESTQLFHEELALQWVVCSGSVRESAL

SEQ ID NO: 27446 - protein, 46 aa, Homo sapiens
  ENSP00000488988
  MOD_RES (1)..(1): Any amino acid
XTTYRNLLYIYPQSLNFANRQGSARNITVKVQFMYGEDPSNAMPVS

SEQ ID NO: 27447 - protein, 632 aa, Homo sapiens
  ENSP00000384446
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPSPSCTHPIPTVRPLPLWCYHSIFSLLSWDFIT

SEQ ID NO: 27448 - protein, 245 aa, Homo sapiens
  ENSP00000483062
PHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKFSGLGFHYYA

SEQ ID NO: 27449 - protein, 173 aa, Homo sapiens
  ENSP00000489164
  MOD_RES (1)..(1): Any amino acid
XECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQVLFCHVGILGRCLCINFFNFRKVVIVLYMYGRVIPRNLKTLRIKIIKATIRMR

SEQ ID NO: 27450 - protein, 443 aa, Homo sapiens
  ENSP00000490677
  MOD_RES (1)..(1): Any amino acid
XQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGGFCNHCYRILLYPSWNTFVPISSGHSSFPQSLATCP

SEQ ID NO: 27451 - protein, 66 aa, Homo sapiens
  ENSP00000418587
MATLPSAERRAFALKINRYSSAEIRKQFTLPPNLGQYHRQSISTSGFPSLQLRRSFSMLSRLVLNS

SEQ ID NO: 27452 - protein, 50 aa, Homo sapiens
  ENSP00000436628
MATLPSAERRAFALKINSHALSPRLEYSGAISAHCNLCLPDSSDSPASAS

SEQ ID NO: 27453 - protein, 2099 aa, Homo sapiens
  ENSP00000394888
MATLPSAERRAFALKINRYSSAEIRKQFTLPPNLGQYHRQSISTSGFPSLQLPQFYDPVEPVDFEGLLMTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 27454 - protein, 66 aa, Homo sapiens
  ENSP00000417082
MTHLNSLDVQLAQELGDFTDDDLDVVFTPKECRTLQPSLPEEGVELDPHVRDCVQTYIREWLIVNR

SEQ ID NO: 27455 - protein, 107 aa, Homo sapiens
  ENSP00000418318
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAA

SEQ ID NO: 27456 - protein, 502 aa, Homo sapiens
  ENSP00000417691
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYREVFQVSAVAH

SEQ ID NO: 27457 - protein, 1999 aa, Homo sapiens
  ENSP00000419438
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 27458 - protein, 439 aa, Homo sapiens
  ENSP00000371768
MHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQVIKELFN

SEQ ID NO: 27459 - protein, 1566 aa, Homo sapiens
  ENSP00000371766
MCGEDASNAMPVRRETNICLKSGWAAHPCHFTQVRDSSVYKVRLFQANTAQHVQGLLCPGYQWGNRVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 27460 - protein, 2031 aa, Homo sapiens
  ENSP00000408464
MTHLNSLDVQLAQELGDFTDDDLDVVFTPKECRTLQPSLPEEGVELDPHVRDCVQTYIREWLIVNRKNQGSPEICGFKKTGSRKDFHKTLPKQTFESETLECSEPAAQAGPRHLNVLCDVSGKGPVTACDFDLRSLQPDKRLENLLQQVSAEDFEKQNEEARRTNRQAELFALYPSVDEEDAVEIRPVPECPKEHLGNRILVKLLTLKFEIEIEPLFASIALYDVKERKKISENFHCDLNSDQFKGFLRAHTPSVAASSQARSAVFSVTYPSSDIYLVVKIEKVLQQGEIGDCAEPYTVIKESDGGKSKEKIEKLKLQAESFCQRLGKYRMPFAWAPISLSSFFNVSTLEREVTDVDSVVGRSSVGERRTLAQSRRLSERALSLEENGVGSNFKTSTLSVSSFFKQEGDRLSDEDLFKFLADYKRSSSLQRRVKSIPGLLRLEISTAPEIINCCLTPEMLPVKPFPENRTRPHKEILEFPTREVYVPHTVYRNLLYVYPQRLNFVNKLASARNITIKIQFMCGEDASNAMPVIFGKSSGPEFLQEVYTAVTYHNKSPDFYEEVKIKLPAKLTVNHHLLFTFYHISCQQKQGASVETLLGYSWLPILLNERLQTGSYCLPVALEKLPPNYSMHSAEKVPLQNPPIKWAEGHKGVFNIEVQAVSSVHTQDNHLEKFFTLCHSLESQVTFPIRVLDQKISEMALEHELKLSIICLNSSRLEPLVLFLHLVLDKLFQLSVQPMVIAGQTANFSQFAFESVVAIANSLHNSKDLSKDQHGRNCLLASYVHYVFRLPEVQRDVPKSGAPTALLDPRSYHTYGRTSAAAVSSKLLQARVMSSSNPDLAGTHSAADEEVKNIMSSKIADRNCSRMSYYCSGSSDAPSSPAAPRPASKKHFHEELALQMVVSTGMVRETVFKYAWFFFELLVKSMAQHVHNMDKRDSFRRTRFSDRFMDDITTIVNVVTSEIAALLVKPQKENEQAEKMNISLAFFLYDLLSLMDRGFVFNLIRHYCSQLSAKLSNLPTLISMRLEFLRILCSHEHYLNLNLFFMNADTAPTSPCPSISSQNSSSCSSFQDQKIASMFDLTSEYRQQHFLTGLLFTELAAALDAEGEGISKVQRKAVSAIHSLLSSHDLDPRCVKPEVKVKIAALYLPLVGIILDALPQLCDFTVADTRRYRTSGSDEEQEGAGAINQNVALAIAGNNFNLKTSGIVLSSLPYKQYNMLNADTTRNLMICFLWIMKNADQSLIRKWIADLPSTQLNRILDLLFICVLCFEYKGKQSSDKVSTQVLQKSRDVKARLEEALLRGEGARGEMMRRRAPGNDRFPGLNENLRWKKEQTHWRQANEKLDKTKAELDQEALISGNLATEAHLIILDMQENIIQASSALDCKDSLLGGVLRVLVNSLNCDQSTTYLTHCFATLRALIAKFGDLLFEEEVEQCFDLCHQVLHHCSSSMDVTRSQACATLYLLMRFSFGATSNFARVKMQVTMSLASLVGRAPDFNEEHLRRSLRTILAYSEEDTAMQMTPFPTQVEELLCNLNSILYDTVKMREFQEDPEMLMDLMYRIAKSYQASPDLRLTWLQNMAEKHTKKKCYTEAAMCLVHAAALVAEYLSMLEDHSYLPVGSVSFQNISSNVLEESVVSEDTLSPDEDGVCAGQYFTESGLVGLLEQAAELFSTGGLYETVNEVYKLVIPILEAHREFRKLTLTHSKLQRAFDSIVNKDHKRMFGTYFRVGFFGSKFGDLDEQEFVYKEPAITKLPEISHRLEAFYGQCFGAEFVEVIKDSTPVDKTKLDPNKAYIQITFVEPYFDEYEMKDRVTYFEKNFNLRRFMYTTPFTLEGRPRGELHEQYRRNTVLTTMHAFPYIKTRISVIQKEEFVLTPIEVAIEDMKKKTLQLAVAINQEPPDAKMLQMVLQGSVGATVNQGPLEVAQVFLAEIPADPKLYRHHNKLRLCFKEFIMRCGEAVEKNKRLITADQREYQQELKKNYNKLKENLRPMIERKIPELYKPIFRVESQKRDSFHRSSFRKCETQLSQGS

SEQ ID NO: 27461 - protein, 331 aa, Homo sapiens
  ENSP00000372160
MASNFNDIVKQGYVKIRSRKLGIFRRCWLVFKKASSKGPRRLEKFPDEKAAYFRNFHKVTELHNIKNITRLPRETKKHAVAIIFHDETSKTFACESELEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARLQTSLTEPMTLSKSISLPRSAYWHHITRQNSVGEIYSLQGHGFGSSKMSRAQTFPSYAPEQSEEAQQPLSRSSSYGFSYSSSLIQ

SEQ ID NO: 27462 - protein, 156 aa, Homo sapiens
  ENSP00000462984
  MOD_RES (1)..(1): Any amino acid
XLEAEEWCKHLCMECLGTRLNDISLGEPDLLAAGVQREQNERFNVYLMPTPNLDIYGECTMQITHENIYLWDIHNAKVKLVMWPLSSLRRYGRDSTWFTFESGRMCDTGEGLFTFQTREGEMIYQKVHSATLAIAEQHERLMLEMEQKARVRPLPW

SEQ ID NO: 27463 - protein, 145 aa, Homo sapiens
  ENSP00000270190
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQ

SEQ ID NO: 27464 - protein, 2298 aa, Homo sapiens
  ENSP00000382104
MDPEEQELLNDYRYRSYSSVIEKALRNFESSSEWADLISSLGKLNKALQSNLRYSLLPRRLLISKRLAQCLHPALPSGVHLKALETYEIIFKIVGTKWLAKDLFLYSCGLFPLLAHAAVSVRPVLLTLYEKYFLPLQKLLLPSLQAFIVGLLPGLEEGSEISDRTDALLLRLSLVVGKEVFYTALWGSVLASPSIRLPASVFVVGHINRDAPGREQKYMLGTNHQLTVKSLRASLLDSNVLVQRNNLEIVLFFFPFYTCLDSNERAIPLLRSDIVRILSAATQTLLRRDMSLNRRLYAWLLGSDIKGNTVVPESEISNSYEDQSSYFFEKYSKDLLVEGLAEILHQKFIDADVEERHHAYLKPFRVLISLLDKPEIGPQVVGNLFLEVIRAFYSYCRDALGSDLKLSYTQSGNSLISAIKENRNASEIVKTVNLLITSLSTDFLWDYMTRCFEECFRPVKQRYSVRNSVSPPPTVSELCALLVFLLDVIPLELYSEVQTQYLPQVLGCLVQPLAEDMEALSLPELTHALKTCFKVLSKVQMPPSYLDTESTSGTSSPVKGENGKIILETKAVIPGDEDASFPPLKSEDSGIGLSASSPELSEHLRVPRVSLERDDVWKKGGSMQRTFLCIQELIANFASKNIFGVQLTASGEESKSEEPAGKRDRDGTQSLAANDSSRKNSWEPKPITVPQFKQMLSDLFTARGSPFKTKSSESPSSSPSSPARKNGGEWDVEKVVIDLGGSREERREAFAAACHLLLDCATFPVYLSEEETEQLCATLFQLPGAGDSSFPSWLKSLMTICCCVTDCYLQNVAISTLLEVINHSQSLALVIEDKMKRYKSSGHNPFFGKLQMVTVPPIAPGILKVIAEKTDFYQRVARVLWNQLNKETREHHVTCVELFYRLHCLAPTANICEDIICHALLDPDKGTRLEALFRFSVIWHLTREIQGSRVTSHNRSFDRSLFVVLDSLACTDGAIGAAAQGWLVRALSLGDVARILEPVLLLLLQPKTQRTSIHCLKQENSADDLHRWFNRKKTSFREACAVPEPQESGSEEHLPLSQFTTVDREAIWAEVEKEPEKYPLRGELSEEELPYYVELPDRTAHGAPDSSEHTESADTSSCHTDSENTSSFSSPSHDLQELSNEENCCAPIPMGGRAYPKRSALLAAFQSESFKAGAKLSLVRVDSDKTQASESFSSDEEADLELQALTTSRLLKQQRERQEAVEALFKHILLYLQPYDSRRVLYAFSVLEAVLKTNPKEFIEAVSRTSMDTSSTAHLNLISNLLARHQEALIGQSFYGKLQTQVPNVCPHSLLLELLTYLCLSFLRSYYPCYLKVSHRDILGNRDVQVKSVEVLIRIMMQLVSVAKSSEGKNVEFIHSLLQRCKVQEFVLLSLSASMYTSQKRYGLATAHHGRALPEDSLFEESLINLGQDQIWSEHPLQIELLKLLQVLIVLEHHLGRAHEEAENQPDLSREWQRALNFQQAISALQYVQPHPLTSQGLLVSAVVRGLQPAYGYGMHPAWVSLVTHSLPYFGKSLGWTVTPFVVQICKNLDDLVKQYESESVKLSVSTTSKRENISPDYPLTLLEGLTTISHFCLLEQANQNKKTMAAGDPANLRNARNAILEELPRTVNTMALLWNVLRKEETQKRPVDLLGATKGSSSVYFKTTKTIRQKILDFLNPLTAHLGVQLTAAVAAVWSRKKAQRHSKMKIIPTASASQLTLVDLVCALSTLQTDTLLHLVKEVVKRPPQVKGGDEKSPLVDIPVLQFCYAFLQRLPVPALQENFSSLLGVLKESVQLNLAPPGYFLLLSMLNDFVTRTPNLENKKDQKDLQEITQKILEAVGNIAGSSLEQTSWLSRNLEVKAQPQASLEESDAEEDLYDAAAASAMVSSSAPSVYSVQALSLLAEVLASLLDMVYRSDEKEKAVPLISRLLYYVFPYLRNHSAYNAPSFRAGAQLLSSLSGYAYTKRAWRKEVLELFLDPAFFQMDTSCVHWKSIIDHLLTHEKTMFKDLMNMQSSSLKLFSSFEQKAMLLKRQAFAVFSGELDQYHLYLPLIQERLTDNLRVGQTSIVAAQMFLFFRVLLLRISPQHLTSLWPIMVSELIQTFTQLEEDLKDEDESLRSTNKVNRTKVSVPDANGPSVGEIPQSELILYLSACKFLDTALSFPPDKMPLFQIYRWAFIPEVDTEGPAFLSDVEENHQECKPHTVRILELLKLKFGEISSSDEITMKSEFPLLRQHSVSSIRQLMPFFMTLNGAFKTQRQLPADSPGTPFLDFPVTDSPRILKQLEECIEYDFLEHPEC

SEQ ID NO: 27465 - protein, 378 aa, Homo sapiens
  ENSP00000450518
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 27466 - protein, 412 aa, Homo sapiens
  ENSP00000381791
MFYGRINGRNFAASSLPVAFAATPLMLFLPNPQLIFSFPISSRNHITGLMPPGKLKLENLFHMCTRLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 27467 - protein, 357 aa, Homo sapiens
  ENSP00000370614
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 27468 - protein, 367 aa, Homo sapiens
  ENSP00000444662
MGFTDLEEPISGCPGGPWALGLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 27469 - protein, 357 aa, Homo sapiens; identical to SEQ ID NO: 27467
  ENSP00000441640

SEQ ID NO: 27470 - protein, 412 aa, Homo sapiens; identical to SEQ ID NO: 27466
  ENSP00000479526

SEQ ID NO: 27471 - protein, 367 aa, Homo sapiens; identical to SEQ ID NO: 27468
  ENSP00000481992

SEQ ID NO: 27472 - protein, 60 aa, Homo sapiens
  ENSP00000391092
MSVILLTPDELTNSSETRLSLEDLFRKDFVLHDPEARWINDTDVVYKSENGHVIKLNIET

SEQ ID NO: 27473 - protein, 796 aa, Homo sapiens
  ENSP00000386565
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 27474 - protein, 746 aa, Homo sapiens
  ENSP00000387038
MSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 27475 - protein, 258 aa, Homo sapiens
  ENSP00000376854
MVITEVAEGPVDGSEKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVP

SEQ ID NO: 27476 - protein, 800 aa, Homo sapiens
  ENSP00000376855
MTAAKQEPQPTPGARASQAQPADQELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 27477 - protein, 789 aa, Homo sapiens
  ENSP00000309066
MRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 27478 - protein, 60 aa, Homo sapiens
  ENSP00000408535
MRKVESRGEGGREMNSQIRQKPDCLWKTSLGKTLCFTIQRLGGSMIQMWCIKARMDMSLN

SEQ ID NO: 27479 - protein, 97 aa, Homo sapiens
  ENSP00000402499
MSVILLTPDELTNSSETRLSLEDLFRKDFVLHDPEARWINDTDVVYKSENGHVIKLNIETNATTLLLENTTFVTFKASRHSVSPDLKYVLLAYDVKQ

SEQ ID NO: 27480 - protein, 748 aa, Homo sapiens
  ENSP00000490722
MVLQARNKHREAAPKPPQPPRASQSPLRGASDVGAGEPGPERAPLSPGRKGAAGRKGPRAEPGAPPAGGGLGGRLAARLRWALGLRRAGRGRTWTTLLLAVFAAVLHWSHITHLFENDRHFSHLSTLEREMAFRTEMGLYYSYFKTIVEAPSFLNGVWMIMNDKLTEYPLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPGAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 27481 - protein, 675 aa, Homo sapiens
  ENSP00000308695
MEGRPPPEGRPPPRPRTGRAPRGRRRAVFAAVLHWSHITHLFENDRHFSHLSTLEREMAFRTEMGLYYSYFKTIVEAPSFLNGVWMIMNDKLTEYPLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPGAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 27482 - protein, 83 aa, Homo sapiens
  ENSP00000412745
  MOD_RES (1)..(1): Any amino acid
XFAGAMPTMASVKLSALRPIVNHPHYEDAGLRPGCSMPEIWDVEDPANAGKTPLCNLLVKDSKPHFTTVFQNSVYKVLEVVKE

SEQ ID NO: 27483 - protein, 206 aa, Homo sapiens
  ENSP00000400510
CTRVMWTPPLRESFSYPFLVLQMLLVTHILRATKLYRGSLIALCISNVFFMLPWQFAQFVLLTQIASLFAVYVVGYIDICKLRKIIYIHMGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAK

SEQ ID NO: 27484 - protein, 85 aa, Homo sapiens
  ENSP00000478865
MYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 27485 - protein, 758 aa, Homo sapiens
  ENSP00000315988
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 27486 - protein, 149 aa, Homo sapiens
  ENSP00000437474
  MOD_RES (1)..(1): Any amino acid
XIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRQMEHREMCLGILKKNEWRTLDTVPIRST

SEQ ID NO: 27487 - protein, 142 aa, Homo sapiens
  ENSP00000445878
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWDFIIHTSRPLLKHLRFWKDCG

SEQ ID NO: 27488 - protein, 124 aa, Homo sapiens
  ENSP00000443126
MFKVFRLFNFIKVGPFQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSD

SEQ ID NO: 27489 - protein, 47 aa, Homo sapiens
  ENSP00000439567
MTFRTEMGLYYSYFKTIIEAPSFLEGLWMIMNDRLTEYPLIINAIKR

SEQ ID NO: 27490 - protein, 90 aa, Homo sapiens
  ENSP00000444932
MRKQGVSSKRLQSSGRSQSKGRRGASLAREPEVEEEMEKSALGGGKLPRGSWRSSPGRIQSLKERKGLELEVVAKTFLLGPFQFVRNSLA

SEQ ID NO: 27491 - protein, 128 aa, Homo sapiens
  ENSP00000428762
MAEEEGPPVELRQRKKPKSSENKESAKEEKISDIPIPERAPKRVYELTHNNKTVSLKTINAVQQMSLYPELIASILYQATGSNEIIEPVYFYIGIVFGLQGIYVTALFVTSWLMSGTWLAGMLTVAWF

SEQ ID NO: 27492 - protein, 44 aa, Homo sapiens
  ENSP00000430162
MAEEEGPPVELRQRKKPKSSENKESAKEEKISDIPIPERAPKRA

SEQ ID NO: 27493 - protein, 723 aa, Homo sapiens
  ENSP00000389630
MAEEEGPPVELRQRKKPKSSENKESAKEEKISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKVYEVYKIYIFSLFLGYLLQFENPALLVSPLLSLVAALMLAKCLQLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILLGSLAMVIEGLKYIWIPYVCMLAAFGVCSPELWMTLFKWLRLRTVHPILLALILSMAVPTIIGLSLWKEFFPRLMTELMELQEFYDPDTVELMTWIKRQAPVAAVFAGSPQLMGAIKLCTGWMVTSLPLYNDDDLLKRNENIYQIYSKRSAEDIYKILTSYKANYLIVEDAICNEVGPMRGCRVKDLLDIANGHMVCEEGDKLTYSKYGRFCHEVKINYSPYVNYFTRVYWNRSYFVYKINTVISFQS

SEQ ID NO: 27494 - protein, 114 aa, Homo sapiens
  ENSP00000428041
  MOD_RES (1)..(1): Any amino acid
XKRKSVTFQFLKELQNELEREITFQGDSAIYYSYYKDMLKAPSFERGVYELTHNNKTVSLKTINAVQQMSLYPELIASILYQATGSNEIIEPVYFYIGIVFGLQGIYVTALFVT

SEQ ID NO: 27495 - protein, 190 aa, Homo sapiens
  ENSP00000430417
KISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINSCTDPWYSVGGDNTGY

SEQ ID NO: 27496 - protein, 67 aa, Homo sapiens
  ENSP00000429559
ATGSNEIIEPVYFYIGIVFGLQGIYVTALFVTSWLMSGTWLAGMLTVAWFVINRAACNLAAGLPYSE

SEQ ID NO: 27497 - protein, 276 aa, Homo sapiens
  ENSP00000429785
  MOD_RES (1)..(1): Any amino acid
XIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILL

SEQ ID NO: 27498 - protein, 75 aa, Homo sapiens
  ENSP00000429711
  MOD_RES (1)..(1): Any amino acid
XWIPYVCMLAAFGVCSPELWMTLFKWLRLRTVHPILLALILSMAVPTIIGLSLWKEKASSSCSCVCRESTVNGCD

SEQ ID NO: 27499 - protein, 1025 aa, Homo sapiens
  ENSP00000359211
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 27500 - protein, 173 aa, Homo sapiens
  ENSP00000307107
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATETLILAFSLMNHL

SEQ ID NO: 27501 - protein, 570 aa, Homo sapiens
  ENSP00000381526
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 27502 - protein, 684 aa, Homo sapiens
  ENSP00000343690
MASGRRGWDSSHEDDLPVYLARPGTTDQVPRQKYGGMFCNVEGAFESKTLDFDALSVGQRGAKTPRSGQGSDRGSGSRPGIEGDTPRRGQGREESREPAPASPAPAGVEIRSATGKEVLQNLGPKDKSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 27503 - protein, 209 aa, Homo sapiens
  ENSP00000430267
  MOD_RES (1)..(1): Any amino acid
XTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 27504 - protein, 75 aa, Homo sapiens
  ENSP00000428958
ADLISQARKKGNVVFGEPITASLGIDGTHYWSKNWAKAAAFVTSPPLSPDPTTPDYINSLLARPQGKWTKTSSWL

SEQ ID NO: 27505 - protein, 92 aa, Homo sapiens
  ENSP00000426720
MSYQGKKNIPRITSDRLLIKGGRIVNDDQSFYADIYMEDGLIKQIGDNLIVPGGVKTIEANGKMVIPGGIDVHTHFQMPYKGMTTVDDFFQG

SEQ ID NO: 27506 - protein, 572 aa, Homo sapiens
  ENSP00000339850
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 27507 - protein, 412 aa, Homo sapiens
  ENSP00000357616
MPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 27508 - protein, 446 aa, Homo sapiens
  ENSP00000377353
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 27509 - protein, 414 aa, Homo sapiens
  ENSP00000278597
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 27510 - protein, 443 aa, Homo sapiens
  ENSP00000354859
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 27511 - protein, 442 aa, Homo sapiens
  ENSP00000441068
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 27512 - protein, 443 aa, Homo sapiens; identical to SEQ ID NO: 27510
  ENSP00000442172

SEQ ID NO: 27513 - protein, 445 aa, Homo sapiens
  ENSP00000438215
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVVQEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 27514 - protein, 177 aa, Homo sapiens
  ENSP00000438419
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNA

SEQ ID NO: 27515 - protein, 7 aa, Homo sapiens
  ENSP00000441474
MDPLNLS

SEQ ID NO: 27516 - protein, 1843 aa, Homo sapiens
  ENSP00000434335
MWLVTFLLLLDSLHKARPEDVGTSLYFVNDSLQQLPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 27517 - protein, 2113 aa, Homo sapiens
  ENSP00000315465
MTGAGEPRREEPPPQPSAGLRSRESGAPSAGGWERAERGRGAAARPATGPPPRRIGPLYGMWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 27518 - protein, 66 aa, Homo sapiens
  ENSP00000436387
MTTSAPRRTLPARSGAPTSASKQFSGNPTPSGWRIKGQCVATWPSSSASSPLQCRNMLALYLGRKT

SEQ ID NO: 27519 - protein, 513 aa, Homo sapiens
  ENSP00000434055
MEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 27520 - protein, 619 aa, Homo sapiens
  ENSP00000227451
MLLASAVVVWEWLNEHGRWRPYSPAVSHHIEAVVRAGPRAGGSVVLGQVDSRLAPYIIDLQSMNQFRQDTGTLRPVRRNYYDPSSAPGKGVVWEWENDNGSWTPYDMEVGITIQHAYEKQHPWIDLTSIGFSYVIDFNTMGQINRQTQRQRRVRRRLDLIYPMVTGTLPKAQSWPVSPGPATSPPMSPCSCPQCVLVMSVKAAVVNGSTGPLQLPVTRKNMPPPGVVKLPPLPGSGAKPLDSTGTIRGPLKTAPSQVIRRQASSMPTGTTMGSPASPPGPNSKTGRVALATLNRTNLQRLAIAQSRVLIASGVPTVPVKNLNGSSPVNPALAGITGILMSAAGLPVCLTRPPKLVLHPPPVSKSEIKSIPGVSNTSRKTTKKQAKKGKTPEEVLKKYLQKVRHPPDEDCTICMERLTAPSGYKGPQPTVKPDLVGKLSRCGHVYHIYCLVAMYNNGNKDGSLQCPTCKTIYGVKTGTQPPGKMEYHLIPHSLPGHPDCKTIRIIYSIPPGIQGPEHPNPGKSFSARGFPRHCYLPDSEKGRKVLKLLLVAWDRRLIFAIGTSSTTGESDTVIWNEVHHKTEFGSNLTGHGYPDANYLDNVLAELAAQGISEDSTAQEKD

SEQ ID NO: 27521 - protein, 169 aa, Homo sapiens
  ENSP00000466351
  MOD_RES (1)..(1): Any amino acid
XKEQRHWDISSSERLDILRDFTNYGLEHWGSDTQGVEKTRRFLLEWLSFLCRYVPVGLLERLPQRINERPPYYLGRDYLETLMASQKAADWIRIRCLGGLELGSCSRGPGVTEGTLQVLGLTSLSTCSPTARCSLGQCPPASPSCRSTRPTRTSSLRLSQGHPGARRVQ

SEQ ID NO: 27522 - protein, 408 aa, Homo sapiens
  ENSP00000315558
MAEGTAEAPLENGGGGDSGAGALERGVAPIKRQYLTTKEQFHQFLEAKGQEKTCRETELDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 27523 - protein, 650 aa, Homo sapiens
  ENSP00000311977
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRLCPSLIQESAAKCFFGDRCRFLHDVGRYLETKPADLGPRCVLFETFGRCPYGVTCRFAGAHLRPEGQNLVQEELAARGTQPPSIRNGLDKALQQQLRKREVRFERAEQALRRFSQGPTPAAAVPEGTAAEGAPRQENCGAQQVPAGPGTSTPPSSPVRTCGPLTDEDVVRLRPCEKKRLDIRGKLYLAPLTTCGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 27524 - protein, 139 aa, Homo sapiens
  ENSP00000468075
  MOD_RES (1)..(1): Any amino acid
XGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTPGSLGLFLSASHSLPPTLRGGFSPSSTAALGSSATPS

SEQ ID NO: 27525 - protein, 171 aa, Homo sapiens
  ENSP00000467987
CGNLPFRRICKRFGADVTCGEMAVCTNLLQGQMSEWALLKRHQCEDIFGVQLEGAFPDTMTKCAELLSRTVEVDFVDINVGCPIDLVYKKGGGCALMNRSTKFQQIVRGMNQVLDVPLTVKIRTGVQERVNLAHRLLPELRDWGVALVTEMGTSCHLRMPTAPCRLVSPGS

SEQ ID NO: 27526 - protein, 217 aa, Homo sapiens
  ENSP00000465369
MAEGTAEAPLENGGGGDSGAGALERGVAPIKRQYLTTKEQFHQFLEAKGQEKTCRETEVGDPAGNELAEPEAKRIRLEDGQTADGQTEEAAEPGEQLQTQKRARGQNKGRPHVKPTNYDKNRTWCRRSWRPAGPSPRPSATAWTKPCSSSCGSARSASSELSRPCAGSARAPHPLPLSPRARQPRALPGRKTVVPSRSPQGRALAPLPAAPCGPAGP

SEQ ID NO: 27527 - protein, 77 aa, Homo sapiens
  ENSP00000467302
TEVGDPAGNELAEPEAKRIRLEDGQTADGQTEEAAEPGEQLQTQKRARGQNKGRPHVKPTNYDKNRLCPSLIQAIGC

SEQ ID NO: 27528 - protein, 37 aa, Homo sapiens
  ENSP00000468233
MREGHHVHARADTSPPRSSFTNSWKPKGRRRLAGKPR

SEQ ID NO: 27529 - protein, 367 aa, Homo sapiens
  ENSP00000239223
MVMEVGTLDAGGLRALLGERAAQCLLLDCRSFFAFNAGHIAGSVNVRFSTIVRRRAKGAMGLEHIVPNAELRGRLLAGAYHAVVLLDERSAALDGAKRDGTLALAAGALCREARAAQVFFLKGGYEAFSASCPELCSKQSTPMGLSLPLSTSVPDSAESGCSSCSTPLYDQGGPVEILPFLYLGSAYHASRKDMLDALGITALINVSANCPNHFEGHYQYKSIPVEDNHKADISSWFNEAIDFIDSIKNAGGRVFVHCQAGISRSATICLAYLMRTNRVKLDEAFEFVKQRRSIISPNFSFMGQLLQFESQVLAPHCSAEAGSPAMAVLDRGTSTTTVFNFPVSIPVHSTNSALSYLQSPITTSPSC

SEQ ID NO: 27530 - protein, 665 aa, Homo sapiens
  ENSP00000298573
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 27531 - protein, 25 aa, Homo sapiens
  ENSP00000443039
MAHEMIGTQIVTERLVALLESGTEK

SEQ ID NO: 27532 - protein, 6 aa, Homo sapiens
  ENSP00000441250
MAHEMI

SEQ ID NO: 27533 - protein, 143 aa, Homo sapiens
  ENSP00000228862
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGADAAEWDWLCVKCQQYLSKA

SEQ ID NO: 27534 - protein, 665 aa, Homo sapiens; identical to SEQ ID NO: 27530
  ENSP00000487512

SEQ ID NO: 27535 - protein, 143 aa, Homo sapiens; identical to SEQ ID NO: 27533
  ENSP00000487034

SEQ ID NO: 27536 - protein, 25 aa, Homo sapiens
  ENSP00000485919
MAHEMIGTQIVTERLVALLESGTEK

SEQ ID NO: 27537 - protein, 6 aa, Homo sapiens
  ENSP00000487493
MAHEMI

SEQ ID NO: 27538 - protein, 75 aa, Homo sapiens
  ENSP00000474082
MLEGVKYLCIPAADSPSQNLTRHFKESIKFIHECRLRGESCLVHCLAGVSRSVTLVIAYIMTVTDFGWEDALHTV

SEQ ID NO: 27539 - protein, 184 aa, Homo sapiens
  ENSP00000345281
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 27540 - protein, 102 aa, Homo sapiens
  ENSP00000474646
MTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 27541 - protein, 102 aa, Homo sapiens; identical to SEQ ID NO: 27540
  ENSP00000474827

SEQ ID NO: 27542 - protein, 18 aa, Homo sapiens
  ENSP00000474450
MPCTPCVLGDPVPTPTWA

SEQ ID NO: 27543 - protein, 54 aa, Homo sapiens
  ENSP00000475106
MGNGMNKILPGLYIGNFKDARDAEQLSKNKVTHILSVHDSARPMLEDKTFQRKY

SEQ ID NO: 27544 - protein, 205 aa, Homo sapiens
  ENSP00000397459
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 27545 - protein, 46 aa, Homo sapiens
  ENSP00000475061
MTVTDFGWEDALHTVRAGRSCANPNVGFQRQLQEFEKHEVHQVSSS

SEQ ID NO: 27546 - protein, 46 aa, Homo sapiens; identical to SEQ ID NO: 27545
  ENSP00000474000

SEQ ID NO: 27547 - protein, 54 aa, Homo sapiens; identical to SEQ ID NO: 27543
  ENSP00000474330

SEQ ID NO: 27548 - protein, 102 aa, Homo sapiens; identical to SEQ ID NO: 27540
  ENSP00000474505

SEQ ID NO: 27549 - protein, 211 aa, Homo sapiens
  ENSP00000256261
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 27550 - protein, 211 aa, Homo sapiens; identical to SEQ ID NO: 27549
  ENSP00000429176

SEQ ID NO: 27551 - protein, 145 aa, Homo sapiens
  ENSP00000430922
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPG

SEQ ID NO: 27552 - protein, 384 aa, Homo sapiens
  ENSP00000358596
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACATHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 27553 - protein, 152 aa, Homo sapiens
  ENSP00000367844
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCGVLLCRPGWSAVMQFRLTATSASQVQVILLPQPPEYLELQAHAITPG

SEQ ID NO: 27554 - protein, 116 aa, Homo sapiens
  ENSP00000367841
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 27555 - protein, 122 aa, Homo sapiens
  ENSP00000402695
MARSLGVLVALPFPLPVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 27556 - protein, 629 aa, Homo sapiens
  ENSP00000469863
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEVLGVQTGGPGGRRAGEPGHSPADYLRFQDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 27557 - protein, 629 aa, Homo sapiens; identical to SEQ ID NO: 27556
  ENSP00000312789

SEQ ID NO: 27558 - protein, 601 aa, Homo sapiens
  ENSP00000472941
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDYQGPGTRRLQEDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 27559 - protein, 589 aa, Homo sapiens
  ENSP00000403182
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYYIVHLKRHFMFRNHLCLVFELLSYNLYDLLRNTHFRGVSLNLTRKLAQQLCTALLFLATPELSIIHCDLKPENILLCNPKRSAIKIVDFGSSCQLGQRIYQYIQSRFYRSPEVLLGTPYDLAIDMWSLGCILVEMHTGEPLFSGSNEVDQMNRIVEVLGIPPAAMLDQAPKARKYFERLPGGGWTLRRTKELRKDLVLRMLEYEPAARISPLGALQHGFFRRTADEATNTGPAGSSASTSPAPLDTCPSSSTASSISSSGGSSGSSSDNRTYRYSNRYCGGPGPPITDCEMNSPQVPPSQPLRPWAGGDVPHKTHQAPASASSLPGTGAQLPPQPRYLGRPPSPTSPPPPELMDVSLVGGPADCSPPHPAPAPQHPAASALRTRMTGGRPPLPPPDDPATLGPHLGLRGVPQSTAASS

SEQ ID NO: 27560 - protein, 172 aa, Homo sapiens
  ENSP00000471609
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVVKAYDHQTQELVAIKIIKNKKAFLNQAQIELRLLELMNQHDTEMKYY

SEQ ID NO: 27561 - protein, 137 aa, Homo sapiens
  ENSP00000472861
MAVPPGHGPFSGFPGPQEHTQVLPDVRLLPRRLPLAFRDATSAPLRKLSVDLIKTYKHINEVYYAKKKRRAQQAPPQDSSNKKEKKVLNHGYDDDNHDYIVRSGERWLERYEIDSLIGKGSFGQVWDTPHHPDPRPH

SEQ ID NO: 27562 - protein, 601 aa, Homo sapiens; identical to SEQ ID NO: 27558
  ENSP00000221803

SEQ ID NO: 27563 - protein, 629 aa, Homo sapiens; identical to SEQ ID NO: 27556
  ENSP00000486377

SEQ ID NO: 27564 - protein, 629 aa, Homo sapiens; identical to SEQ ID NO: 27556
  ENSP00000485915

SEQ ID NO: 27565 - protein, 601 aa, Homo sapiens; identical to SEQ ID NO: 27558
  ENSP00000486839

SEQ ID NO: 27566 - protein, 601 aa, Homo sapiens; identical to SEQ ID NO: 27558
  ENSP00000487313

SEQ ID NO: 27567 - protein, 589 aa, Homo sapiens; identical to SEQ ID NO: 27559
  ENSP00000487539

SEQ ID NO: 27568 - protein, 172 aa, Homo sapiens; identical to SEQ ID NO: 27560
  ENSP00000486913

SEQ ID NO: 27569 - protein, 137 aa, Homo sapiens; identical to SEQ ID NO: 27561
  ENSP00000486264

SEQ ID NO: 27570 - protein, 634 aa, Homo sapiens
  ENSP00000439697
MQLLPPPIRTGTKTQMDAKKPRKCDLTPFLVLKARKKQKFTSAKVGSKLSVQIQKPPSNIKNSRMTQVFHKNTSVTSLPFVDTKGKKNTVSFPHISKKVLLKSSLLYQENQAHNQMPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKDEITKETTEKTKDSPTKHVQHSGDQQDCLQHGADTVQLPQLVDAPKKSEAAVGAEVSMTSPGQSKNFSLKNTNVLPPIV

SEQ ID NO: 27571 - protein, 68 aa, Homo sapiens
  ENSP00000441996
MQLLPPPIRTGTKTQMDAKKPRKCDLTPFLVLKARKKQKFTSAKGPTLSEIYMEETRRSQLRKQENRL

SEQ ID NO: 27572 - protein, 59 aa, Homo sapiens
  ENSP00000444842
MQLLPPPIRTGTKTQMDAKKPRKCDLTPFLVLKARKKQKFTSAKEETRRSQLRKQENRL

SEQ ID NO: 27573 - protein, 43 aa, Homo sapiens
  ENSP00000439168
MQLLPPPIRTGTKLKWRLGKSRRPFSGKVQTVETTNENVLCLA

SEQ ID NO: 27574 - protein, 520 aa, Homo sapiens
  ENSP00000441755
MPASELKASEIPFHPSIKTQDPKAEEKSPKKQKVTLTAAEALKLFKNQLSPYEQSEILGYAELWFLGLEAKKLDTAPEKFSKTSFDDEHGFYLKVLHDHIAYRYEVLETIGKGSFGQVAKCLDHKNNELVALKIIRNKKRFHQQALMELKILEALRKKDKDNTYNVVHMKDFFYFRNHFCITFELLGINLYELMKNNNFQGFSLSIVRRFTLSVLKCLQMLSVEKIIHCDLKPENIVLYQKGQASVKVIDFGSSCYEHQKVYTYIQSRFYRSPEVILGHPYDVAIDMWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKADEITKETTEKTKDSPTKHVQHSGDQQDCLQHGADTVQLPQLVDAPKKSEAAVGAEVSMTSPGQSKNFSLKNTNVLPPIV

SEQ ID NO: 27575 - protein, 120 aa, Homo sapiens
  ENSP00000438769
  MOD_RES (1)..(1): Any amino acid
XSKGFPKNITNNRGKKRYPDSKDLTMVLKTYDTSFLDFLRRCLVWEPSLRMTPDQALKHAWIHQSRNLKPQPRPQTLRKSNSFFPSETRKDKVQGCHHSSRKGTACQITSPSPTVRELIF

SEQ ID NO: 27576 - protein, 520 aa, Homo sapiens; identical to SEQ ID NO: 27574
  ENSP00000010132

SEQ ID NO: 27577 - protein, 2097 aa, Homo sapiens
  ENSP00000387137
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27578 - protein, 2118 aa, Homo sapiens
  ENSP00000386547
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27579 - protein, 2101 aa, Homo sapiens
  ENSP00000398305
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27580 - protein, 2111 aa, Homo sapiens
  ENSP00000407046
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27581 - protein, 2080 aa, Homo sapiens
  ENSP00000258104
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27582 - protein, 2112 aa, Homo sapiens
  ENSP00000386683
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27583 - protein, 2081 aa, Homo sapiens
  ENSP00000377678
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27584 - protein, 2088 aa, Homo sapiens
  ENSP00000386285
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27585 - protein, 2102 aa, Homo sapiens
  ENSP00000386512
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27586 - protein, 2119 aa, Homo sapiens
  ENSP00000386881
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQLADGLSSLAPTNTASPPSSPHEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27587 - protein, 2098 aa, Homo sapiens
  ENSP00000386617
MLCCLLVRASNLPSAKKDRRSDPVASLTFRGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVAGGGQSRAETWSLLSDSTMDTRYSGKKWPAPTDTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEVDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 27588 - protein, 225 aa, Homo sapiens
  ENSP00000479439
  MOD_RES (1)..(1): Any amino acid
XTQSLIKDLKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 27589 - protein, 247 aa, Homo sapiens
  ENSP00000366857
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPVPRFCTRKRSEVFDKHGDNENSKGDRLSQVCPLPCPPAIRSLCSLLSRMWLSCPTHIWLSSPTPRRSSDGLVCRMQKLGTHEHSHLCGV

SEQ ID NO: 27590 - protein, 559 aa, Homo sapiens
  ENSP00000349774
MRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSEPRCAWQSLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 27591 - protein, 752 aa, Homo sapiens
  ENSP00000351734
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 27592 - protein, 189 aa, Homo sapiens
  ENSP00000476391
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQARHSPIYI

SEQ ID NO: 27593 - protein, 574 aa, Homo sapiens
  ENSP00000477046
MTAGSVCVPQIIPLRVPQPGKANHEIDNNTLLEMKSDTPDVNIYYTLDGSKPEFLKRIGYGENNTFKYIKPITLPDGKIQVKAIAVSKDCRQSGIVTKVFHVDYEPPNIVSPEDNVENVLKDSSRQEFKNGFVGSKLKKKYKNSENQRSWNVNLRKFPESPLEIPAYGGGSGSRPPTRQSQSPGFAHVSGQKCLTSTEIMRIQRETDFLKCAHCLAPRPSDPFARFCQECGSPVPPIFGCRLPPPEGAQMGLCAECRSLVPMNTPICVVCEAPLALQLQPQASLHLKEKVICRACGTGNPAHLRYCVTCEGALPSSQESMCSGDKAPPPPTQKGGTISCYRCGRWNLWEASFCGWCGAMLGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKVRKLRLREVKQPASSKGTKLVSGRPRIHTWQPETFPS

SEQ ID NO: 27594 - protein, 140 aa, Homo sapiens
  ENSP00000484666
MSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQL

SEQ ID NO: 27595 - protein, 247 aa, Homo sapiens; identical to SEQ ID NO: 27589
  ENSP00000477872

SEQ ID NO: 27596 - protein, 752 aa, Homo sapiens; identical to SEQ ID NO: 27591
  ENSP00000262547

SEQ ID NO: 27597 - protein, 462 aa, Homo sapiens
  ENSP00000328866
MGLCAECRSLVPMNTPICVVCEAPLALQLQPQASLHLKEKVICRACGTGNPAHLRYCVTCEGALPSSQELGIPAGCSVCPKCGASNHLSARFCGSCGICVKSLVKLSLDRSLALAAEEPRPFSESLNIPLPRSDVGTKRDIGTQTVGLFYPSGKLLAKKEQELASQKQRQEKMSDHKPLLTAISPGRGYWRRQLDHISAHLRCYAQNNPEFRALIAEPRMGKLISATVHEDGCEVSIRLNYSQVSNKNLYLNKAVNFSDHLLSSAAEGDGGLCGSRSSWVSDYSQSTSDTIEKIKRIKNFKTKTFQEKKEQLIPENRLLLKEVGPTGEGRVSVIEQLLDEGADPNCCDEDNRPVITVAVMNKHHEAIPVLVQRGADIDQQWGPLRNTALHEATLLGLAGRESTATLLGCNASIQKKNAGGQTAYDLALNTGDDLVTSLFAAKFGQGLEDQLAQTRSLSLDDC

SEQ ID NO: 27598 - protein, 767 aa, Homo sapiens
  ENSP00000332148
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSVKSQQSTLVTREAQPKTRTLQVALPSTPAEPPPPTRQSHGSHGSSLTQVSAPAPRPGLHGPSSTPPSSGPGMSTPPFSSEEDSEGDRVQRVSLQPPKVPSRMVPRPKDDWDWSDTETSEENAQPPGQGSGTLVQSMVKNLEKQLEAPAKKPAGGVSLFFMPNAGPQRAATPGRKPQLSEDESDLEISSLEDLPLDLDQREKPKPLSRSKLPEKFGTGPQSSGQPRVPAW

SEQ ID NO: 27599 - protein, 148 aa, Homo sapiens
  ENSP00000417228
  MOD_RES (1)..(1): Any amino acid
XQPPKVPSRMVPRPKDDWDWSDTETSEENAQPPGQGSGTLVQSMVKNLEKQLEAPAKKPAGGVSLFFMPNAGPQRAATPGRKPQVGCRMLRVYSGILYRTSSEFGGPGVKVGEGPASVILCPSGTLWVTSLCPCAHGEMASLEYLYPS

SEQ ID NO: 27600 - protein, 539 aa, Homo sapiens
  ENSP00000419486
MQSPAATAEGLSGPLFGAYTFPTFKFQPRHDSMDWRRISTLDVDRVARELDVATLQENIAGITFCNLDREVCSRCGQPVDPALLKVLRLAQLIIEYLLHCQDCLSASVAQLEARLQTSLGQQQRGQQELGRQADELKGVREESRRRRKMISTLQQLLMQTGTHSYHTCHLCDKTFMNATFLRGHIQRRHAGVAEGGKQKKQEQPVEEVLEELRAKLKWTQGELEAQREAERQRQLQEAELIHQREIEAKKEFDKWKEQEWTKLYGEIDKLKKLFWDEFKNVAKQNSTLEEKLRALQSHSVMESKLGSLRDEESEEWLRQARELQALREKTEIQKTEWKRKVKELHEEHMAEKKELQEENQRLQASLSQDQKKAAAQSQCQISTLRAQLQEQARIIASQEEMIQSLSLRKVEGIHKVPKAVDTEEDSPEEEMEDSQDEQHKVLAALRRNPTLLKHFRPILEDTLEEKLESMGIRKDAKGISIQTLRHLESLLRVQREQKARKFSEFLSLRGKLVKEVTSRAKERQENGAVVSQPDGQPSG

SEQ ID NO: 27601 - protein, 67 aa, Homo sapiens
  ENSP00000420600
MQSPAATAEGLSGPLFGAYTFPTFKFQPRHDSMDWRRISTLDVDRVARELDVATLQENIAGITFCNL

SEQ ID NO: 27602 - protein, 39 aa, Homo sapiens
  ENSP00000420051
MQSPAATAEGLSGPLFGAYTFPTFKFQPRHDSMDWRRIS

SEQ ID NO: 27603 - protein, 465 aa, Homo sapiens
  ENSP00000262904
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 27604 - protein, 334 aa, Homo sapiens
  ENSP00000443418
MPLQQQAKRRLELGESGHQYLSDGLKTPKGKGRAALRSPDSPKKKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 27605 - protein, 128 aa, Homo sapiens
  ENSP00000483249
MDKRALLASPGFAAPPAKRRLELGESGHQYLSDGLKTPKGKGRAALRSPDSPKKKTRYDTSLGLLTKKFIQLLSQSPDGVLDLNKAAEVLKVQKRRIYDITNVLEGISDLFDAYDLEKLPLVEDFMCS

SEQ ID NO: 27606 - protein, 591 aa, Homo sapiens
  ENSP00000322898
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 27607 - protein, 560 aa, Homo sapiens
  ENSP00000370029
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 27608 - protein, 523 aa, Homo sapiens
  ENSP00000428020
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQVVPSSPTMASSTSLPSNCSSSSGIFSFSPANMVSAVKQKSAFAPVVRPQTSPPPTCTSTNGNSLQAISGMIVPPM

SEQ ID NO: 27609 - protein, 407 aa, Homo sapiens
  ENSP00000477809
RFFLKFFLKCNQNCLKNAGNPRDMRRFQVVVSTTVNVDGHVLAVSDNMFVHNNSKHGRRARRLDPSEGTPSYLEHATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 27610 - protein, 575 aa, Homo sapiens
  ENSP00000430241
MFGIQDTLGRGPTLKEKSLGAEMDSVRSWVRNVGVVDANVAAQSGVALSRAHFEKQPPSNLRKSNFFHFVLALYDRQGQPVEIERTAFVDFVENDKEQGNEKTNNGTHYKLQLLYSNGVRTEQDLYVRLIDSVTKQPIAYEGQNKNPEMCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 27611 - protein, 427 aa, Homo sapiens
  ENSP00000386178
MCRVLLTHEVMCSRCCEKKSCGNRNETPSDPVIIDRFFLKFFLKCNQNCLKTAGNPRDMRRFQVVLSTTVNVDGHVLAVSDNMFVHNNSKHGRRARRLDPSEATPCIKAISPSEGWTTGGAMVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGIMSSSPTVGSSSTSSILPFSSSVFPAVKQKSAFAPVIRPQGSPSPACSSGNGNGFRAMTGLVVPPM

SEQ ID NO: 27612 - protein, 264 aa, Homo sapiens
  ENSP00000437909
MVIIIGDNFFDGLQVVFGTMLVWSELITPHAIRVQTPPRHIPGVVEVTLSYKSKQFCKGAPGRFIYTALNEPTIDYGFQRLQKVIPRHPGDPERLAKEMLLKRAADLVEALYGTPHNNQDIILKRAADIAEALYSVPRNPSQLPALSSSPAHSGMMGINSYGSQLGVSISESTQGNNQGYIRNTSSISPRGYSSSSTPQQSNYSTSSNSMNGYSNVPMANLGVPGSPGFLNGSPTGSPYGTGLWLTWLLKAFWGKKRIETIPFL

SEQ ID NO: 27613 - protein, 551 aa, Homo sapiens
  ENSP00000357637
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGMKQKSAFAPVVRPQASPPPSCTSANGNGLQAMSGLVVPPM

SEQ ID NO: 27614 - protein, 596 aa, Homo sapiens
  ENSP00000347463
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTAPSYLENATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQAMSGLVVPPM

SEQ ID NO: 27615 - protein, 191 aa, Homo sapiens
  ENSP00000387543
  MOD_RES (1)..(1): Any amino acid
XFSSQLAVNVSETSQANDQVGYSRNTSSVSPRGYVPSSTPQQSNYNTVSTSMNGYGSGAMASLGVPGSPGFLNGSSANSPYGIVPSSPTMAASSVTLPSNCSSTHGIFSFSPANVISAVKQKSAFAPVVRPQASPPPSCTSANGNGLQGSLLGAEDVAAEKTNWPFCEVGGIFHFDELMLKKGTGKLCLGW

SEQ ID NO: 27616 - protein, 540 aa, Homo sapiens
  ENSP00000405003
MDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAKERLRPRAAPPKLPTPGLPQSPRRGASRPVF

SEQ ID NO: 27617 - protein, 621 aa, Homo sapiens
  ENSP00000345030
RPRRGGAGTGPRGESAGLLLLLLQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 27618 - protein, 602 aa, Homo sapiens
  ENSP00000477023
MFPAQDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 27619 - protein, 177 aa, Homo sapiens
  ENSP00000477107
LIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAAPTSFETCTLMLAASCLPVGALGMEEAEEGVPGLLYLGSSPSGCLMDSGPTHSQ

SEQ ID NO: 27620 - protein, 598 aa, Homo sapiens
  ENSP00000370022
MDALPRSGLNLKEEPLLPAGLGSVRSWMQGAGILDASTAAQSGVGLARAHFEKQPPSNLRKSNFFHFVLAMYDRQGQPVEVERTAFIDFVEKDREPGAEKTNNGIHYRLRLVYNNGLRTEQDLYVRLIDSMSKQAIIYEGQDKNPEMCRVLLTHEIMCSRCCDRKSCGNRNETPSDPVIIDRFFLKFFLKCNQNCLKNAGNPRDMRRFQVVVSTTVSVDGHVLAVSDNMFVHNNSKHGRRARRLDPSEAATPCIKAISPGEGWTTGGATVIVIGDNFFDGLQVVFGNVLVWSELITPHAIRVQTPPRHIPGVVEVTLSYKSKQFCKGCPGRFVYTALNEPTIDYGFQRLQKVIPRHPGDPERLPKEVLLKRAADLAEALYGVPGSNQELLLKRAADVAEALYSTPRAPGPLAPLAPSHPHPAVVGINAFSSPLAIAVGDATPGPEPGYARSCSSASPRGFAPSPGSQQSGYGGGLGAGLGGYGAPGVAGLGVPGSPSFLNGSTATSPFAIMPSSPPLAAASSMSLPAAAPTTSVFSFSPVNMISAVKQRSAFAPVLRPPSSPPQACPRAHGEGLPDQSFEDSDKFHSPARGLQGLAYS

SEQ ID NO: 27621 - protein, 87 aa, Homo sapiens
  ENSP00000475102
  MOD_RES (1)..(1): Any amino acid
XSVMAPVDVDLNLVSNILESYSSQAGLAGPASNLLQSMGVQLPDNTDHRPTNGVSLCCPGWSAVALSWLNASSTSQVHAILLPQPPE

SEQ ID NO: 27622 - protein, 644 aa, Homo sapiens
  ENSP00000362070
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 27623 - protein, 163 aa, Homo sapiens
  ENSP00000433778
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGSHSLNVYMHNWCNKGLCQTGGVDTGCLLHLIPSTEPMNWA

SEQ ID NO: 27624 - protein, 601 aa, Homo sapiens
  ENSP00000395786
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSAHGFEILCSKCSPHFSDCKKSLVTASPLWASFLESLKKNDYFKGLIEGSAQYRERLEMAENYFQLSVDWPESSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 27625 - protein, 677 aa, Homo sapiens
  ENSP00000401566
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYRLPPPSDPQYRAHELGMKLAHGFEILCSKCSPHFSDCKKSLVTASPLWASFLESLKKNDYFKGLIEGSAQYRERLEMAENYFQLSVDWPERLEVQWRDPGLLQAPPPGFTPFICLSLLSTWDNSSLAMSPGEEILTLLQTIPFDIEDLKKEAANLPPEDDDQWLDLSPDQLDQLLQEAVGKKESESVSKEEKEQNYDLTEVSESMKAFISKVSTHKGAELPREPSEAPITFDADSFLNYFDKILGPRPNESDSDDLDDEDFECLDSDDDLDFETHEPGEEASLKGTLDNLKSYMAQMDQELAHTCISKSFTTRNQVEPVSQTTDNNSDEEDSGTGESVMAPVDVDLNLVSNILESYSSQAGLAGPASNLLQSMGVQLPDNTDHRPTSKPTKN

SEQ ID NO: 27626 - protein, 212 aa, Homo sapiens
  ENSP00000391367
MFGVTKFGDNIEDEWFIVYVIKQITKEFPELVARIEDNDGEFLLIEAADFLPKWLDPENSTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDLRACRVFKTFLPETRIMTSVTFTKCLYAQLVQQRFVPDRRSGYR

SEQ ID NO: 27627 - protein, 217 aa, Homo sapiens
  ENSP00000416288
MEETMKLATMEDTVEYCLFLIPDESRDSDKHKEILQKYIERIITRFAPMLVPYIWQNQPFNLKYKPGKGGVPAHMFGVTKFGDNIEDEWFIVYVIKQITKEFPELVASTNRVFFCHGELCIIPAPRKSGAESWLPTTPPTIPQALNIITAHSEKILASESIRAAVNRRIRGYPEKIQASLHRAHCFLPAGIVAVLKQRPRLVAAAVQAFYLRDPIDL

SEQ ID NO: 27628 - protein, 754 aa, Homo sapiens
  ENSP00000405088
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27629 - protein, 758 aa, Homo sapiens
  ENSP00000349581
MPLQGLGLQRNPFLQGKRGPGLTSSPPLLPPSLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27630 - protein, 770 aa, Homo sapiens
  ENSP00000364028
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27631 - protein, 738 aa, Homo sapiens
  ENSP00000388439
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRVWCSVRTPESSHEGLITDPHSPSRFRVIGSLSNSKEFSEHFRCPPGSPMNPPHKCEVW

SEQ ID NO: 27632 - protein, 767 aa, Homo sapiens
  ENSP00000264205
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 27633 - protein, 77 aa, Homo sapiens
  ENSP00000431856
MDPTVDPCHDFFSYACGGWIKANPVPDGHSRWGTFSNLWEHNQAIIKHLLENSTASVSEAERKAQVYYRACMNETRI

SEQ ID NO: 27634 - protein, 134 aa, Homo sapiens
  ENSP00000436633
MEQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGT

SEQ ID NO: 27635 - protein, 103 aa, Homo sapiens
  ENSP00000432860
MSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVD

SEQ ID NO: 27636 - protein, 292 aa, Homo sapiens
  ENSP00000360577
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 27637 - protein, 65 aa, Homo sapiens
  ENSP00000360575
MLRVLCLLRPWRPLRARGCASDGAAGGSEIQVRALAGPDQGKCAVPGRRMTRLGLGRRQRGTGRL

SEQ ID NO: 27638 - protein, 261 aa, Homo sapiens
  ENSP00000351125
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 27639 - protein, 48 aa, Homo sapiens
  ENSP00000446190
MLRVLCLLRPWRPLRARGCASDGAAGGSEIQVRALAGPDQDKAEDPGR

SEQ ID NO: 27640 - protein, 219 aa, Homo sapiens
  ENSP00000441962
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQVDIASGMAIEGMCYAQ

SEQ ID NO: 27641 - protein, 49 aa, Homo sapiens
  ENSP00000439906
MLRVLCLLRPWRPLRARGCASDGAAGGSEIQVRALAGPDQGCRFHEDRP

SEQ ID NO: 27642 - protein, 43 aa, Homo sapiens
  ENSP00000438535
MLRVLCLLRPWRPLRARGCASDGAAGGSEIQVRALAGPDQAGH

SEQ ID NO: 27643 - protein, 244 aa, Homo sapiens
  ENSP00000439264
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQVDIASGMAIEGMCYAQNIPTRDRLEGMAAFREKRTPKFVGK

SEQ ID NO: 27644 - protein, 78 aa, Homo sapiens
  ENSP00000393659
MRDLARGMFVFGYDNYMAHAFPQDELNPIHCRGRGPDRGDPSNLNINDVLGNYSLTLVDALDTLAGPGKPPFCSQNNN

SEQ ID NO: 27645 - protein, 657 aa, Homo sapiens
  ENSP00000256497
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 27646 - protein, 53 aa, Homo sapiens
  ENSP00000394615
MPAAPARPCNGERSSWGWCSSGLASMEYCGSSSGWGPAWASTSAFRSASASSV

SEQ ID NO: 27647 - protein, 376 aa, Homo sapiens
  ENSP00000394099
MGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLVCVLQDEPRNI

SEQ ID NO: 27648 - protein, 480 aa, Homo sapiens
  ENSP00000296591
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 27649 - protein, 470 aa, Homo sapiens
  ENSP00000369483
MKRSVAVWLLVGLSLGVPQFGKGDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 27650 - protein, 532 aa, Homo sapiens
  ENSP00000366416
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 27651 - protein, 442 aa, Homo sapiens
  ENSP00000335311
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 27652 - protein, 436 aa, Homo sapiens
  ENSP00000486202
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 27653 - protein, 78 aa, Homo sapiens
  ENSP00000487082
MQPPPSLCGRALVALVLACGLSRIWGEERGFPPDRATPLLQTAEIMTPPTKTLWPKGSNASLARSLAPAEVPKGDRTA

SEQ ID NO: 27654 - protein, 595 aa, Homo sapiens
  ENSP00000194130
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 27655 - protein, 36 aa, Homo sapiens
  ENSP00000388403
MKFFSYILVYRRFLFVVFTVLVLLPLPIVLHTKSKL

SEQ ID NO: 27656 - protein, 40 aa, Homo sapiens
  ENSP00000401417
MKFFSYILVYRRFLFVVFTVLVLLPLPIVLHTKLILTFPR

SEQ ID NO: 27657 - protein, 161 aa, Homo sapiens
  ENSP00000441309
MLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKYLQVR

SEQ ID NO: 27658 - protein, 493 aa, Homo sapiens
  ENSP00000378058
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 27659 - protein, 46 aa, Homo sapiens
  ENSP00000489578
MLKALFLTMLTLALVKSQDTEETITYTQCTDGYEWDPVRQQCKEDS

SEQ ID NO: 27660 - protein, 493 aa, Homo sapiens; identical to SEQ ID NO: 27658
  ENSP00000347596

SEQ ID NO: 27661 - protein, 280 aa, Homo sapiens
  ENSP00000489183
  MOD_RES (1)..(1): Any amino acid
XNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 27662 - protein, 172 aa, Homo sapiens
  ENSP00000392055
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQ

SEQ ID NO: 27663 - protein, 119 aa, Homo sapiens
  ENSP00000408195
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFV

SEQ ID NO: 27664 - protein, 106 aa, Homo sapiens
  ENSP00000398345
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASS

SEQ ID NO: 27665 - protein, 87 aa, Homo sapiens
  ENSP00000389319
MLKALFLTMLTLALVKSQDTEETITYTQCTDGYEWDPVRQQCKDIDECDIVPDACKGGMKCVNHYGGYLCLPKTAQIIVNNEQPQQE

SEQ ID NO: 27666 - protein, 61 aa, Homo sapiens
  ENSP00000399480
MLKALFLTMLTLALVKSQDTEETITYTQCTDGYEWDPVRQQCKDIDECDIVPDACKGGMKC

SEQ ID NO: 27667 - protein, 51 aa, Homo sapiens
  ENSP00000405686
MLKALFLTMLTLALVKSQDTEETITYTQCTDGYEWDPVRQQCKDIDECDIV

SEQ ID NO: 27668 - protein, 27 aa, Homo sapiens
  ENSP00000398387
MLKALFLTMLTLALVKSQDTEETITYT

SEQ ID NO: 27669 - protein, 749 aa, Homo sapiens
  ENSP00000404232
MALPLLPGNSFNRNVGKEKFHKSQHWGFCNNVMMLVSDEKPGIGGEPLLGQKIKPKCSIYPKGDGSDVPSWVAFDKQVLSFDAYLEEEVLDKSQTNYRIRYYKIYFYPEDDTIQVNEPEVKNSGLLQGTSIRRHRITLPPPDEDQFYTVYHFNVGTEVVFYGRTFKIYDCDAFTRNFLRKIGVKVNPPVQCPEDPYMKIRREVVEHVEPLRPYESLDTLKQFLQYHGKILCFFCLWDDSVSMFGDRRELILHYFLCDDTIEIKELLPHSSGRDALKMFLRRSKLPKNCPPRVYQPGQITDRAVLNSYGDFIKNQADGYLFDRYKLGKVDQEFYKDSDLSLGVTINVWGRKVLLYDCDEFTKSYYKSKYGIENFTSVSCKPPSPPPKIERKFPPYNGFGSEEDSLRNCIDLKPTPHRRNFKKFMEKDSYGSKSNILRFFAKLVTDKCVDLDRMFVISYYLGDDTISVFEPIERNSGIAGGMFLKRSRVKKPGQEVFKSELSEYIKAEELYIGVTVNVNGYLFRLLNADEYTLNYMEQNTDKYPFSNLKLALQKLKQEEGKSRELKQVFKAADSKHTNMVDYNTFRDILMSLTVGNLAEQEFVTIARHYRVPEGTCSDMDFLIALAHEKFKKNMFENFDTFIYSCVYEDREKKNVLPTKDIKRLCKSSRLPLSDDLLESLLSRFEDSEKQIDYKSFFSALNWRKNPVPELQPASYLKERCEDVWLGMPSPIPAKYIDYWTFLKDAFGLEEE

SEQ ID NO: 27670 - protein, 143 aa, Homo sapiens
  ENSP00000386556
MGELQYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 27671 - protein, 239 aa, Homo sapiens
  ENSP00000264059
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 27672 - protein, 99 aa, Homo sapiens
  ENSP00000395119
  MOD_RES (1)..(1): Any amino acid
XELACKLERRLRREEAEESGPQLAPLGAPAPEPKPEPEPPARAPTASADAELSAQLSRRLDINEGAARPRRCRVFNPYTEFPEFSRRLIKDLESMFKLI

SEQ ID NO: 27673 - protein, 127 aa, Homo sapiens
  ENSP00000386243
MELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 27674 - protein, 81 aa, Homo sapiens
  ENSP00000401073
MELKLMMEKLGAPQTHLGLKSMIKEVDEDFDGKLSFREFLLIFHKAAAGELQEDSGLMALAKLSEIDVALEGVKGAKNFFE

SEQ ID NO: 27675 - protein, 127 aa, Homo sapiens; identical to SEQ ID NO: 27673
  ENSP00000386685

SEQ ID NO: 27676 - protein, 142 aa, Homo sapiens [sequence omitted]

SEQ ID NO: 27677 - protein, 240 aa, Homo sapiens
  ENSP00000365147
MATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 27678 - protein, 179 aa, Homo sapiens
  ENSP00000395153
  MOD_RES (1)..(1): Any amino acid
XKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWAPRTGSRGSGWQQLERLPSSALALQQPQNIGPGHQRVQPLRGGDQGRAGGKEEAGGGDEAAESGLQGAAVHL

SEQ ID NO: 27679 - protein, 188 aa, Homo sapiens [sequence omitted]

SEQ ID NO: 27680 - protein, 228 aa, Homo sapiens
  ENSP00000328777
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 27681 - protein, 201 aa, Homo sapiens
  ENSP00000426989
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNDTVHESAEPSRGENAAQTPRIPSRLLAILLFLLAMLLTL

SEQ ID NO: 27682 - protein, 340 aa, Homo sapiens
  ENSP00000226091
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 27683 - protein, 728 aa, Homo sapiens
  ENSP00000386082
MYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEEVSVRATVLGQPHLL

SEQ ID NO: 27684 - protein, 817 aa, Homo sapiens
  ENSP00000384081
MYGVCGCCGALRPRYKRLVDNIFPEDPEDGLVKTNMEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 27685 - protein, 782 aa, Homo sapiens
  ENSP00000385832
MEKLTFYALSAPEKLDRIGAYLSERLIRDVGRHRYGYVCIAMEALDQLLMACHCQSINLFVESFLKMVAKLLESEKPNLQILGTNSFVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 27686 - protein, 669 aa, Homo sapiens
  ENSP00000384454
MCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQDVAQVNEENLPVYNRCALYALGAAYLNLISQLTTVPAFCQHIHEVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 27687 - protein, 652 aa, Homo sapiens
  ENSP00000264719
FVKFANIEEDTPSYHRSYDFFVSRFSEMCHSSHDDLEIKTKIRMSGIKGLQGVVRKTVNDELQANIWDPQHMDKIVPSLLFNLQHVEEAESRSPSPLQAPEKEKESPAELAERCLRELLGRAAFGNIKNAIKPVLIHLDNHSLWEPKVFAIRCFKIIMYSIQPQHSHLVIQQLLGHLDANSRSAATVRAGIVEVLSEAAVIAATGSVGPTVLEMFNTLLRQLRLSIDYALTGSYDGAVSLGTKIIKEHEERMFQEAVIKTVGSFASTLPTYQRSEVILFIMSKVPRPSLHQAVDTGRTGENRNRLTQIMLLKSLLQVSTGFQCNNMMSALPSNFLDRLLSTALMEDAEIRLFVLEILISFIDRHGNRHKFSTISTLSDISVLKLKVDKCSRQDTVFMKKHSQQLYRHIYLSCKEETNVQKHYEALYGLLALISIELANEEVVVDLIRLVLAVQVIETRKKEAPYMLPEDVFVERPRLSQNLDGVVIELLFRQSKISEVLGGSGYNSDRLCLPYIPQLTDEDRLSKRRSIGETISLQVEVESRNSPEKEERVPAEEITYETLKKAIVDSVAVEEQERERRRQVVEKFQKAPFEEIAAHCGARASLLQSKLNQIFEITIRPPPSPSGTITAAYGQPQNHSIPVYEMKFPDLCVY

SEQ ID NO: 27688 - protein, 1165 aa, Homo sapiens
  ENSP00000424316
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27689 - protein, 1207 aa, Homo sapiens
  ENSP00000265171
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27690 - protein, 1166 aa, Homo sapiens
  ENSP00000421384
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27691 - protein, 128 aa, Homo sapiens
  ENSP00000413354
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQ

SEQ ID NO: 27692 - protein, 464 aa, Homo sapiens
  ENSP00000492462
MSSLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRR

SEQ ID NO: 27693 - protein, 1165 aa, Homo sapiens
  ENSP00000395243
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 27694 - protein, 1091 aa, Homo sapiens
  ENSP00000415559
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 27695 - protein, 628 aa, Homo sapiens
  ENSP00000342376
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 27696 - protein, 705 aa, Homo sapiens
  ENSP00000345973
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 27697 - protein, 405 aa, Homo sapiens
  ENSP00000413843
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 27698 - protein, 1210 aa, Homo sapiens [sequence omitted]

SEQ ID NO: 27699 - protein, 239 aa, Homo sapiens
  ENSP00000250457
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 27700 - protein, 145 aa, Homo sapiens
  ENSP00000447470
MPLGHIMRLDLEKIALEYIVPCLHEAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 27701 - protein, 79 aa, Homo sapiens
  ENSP00000451316
MAMVACYPGNGTGYVRHVDNPNGDGRCITCIYYLNKNWDAKLHGGILRIFPEGKSFIADVEPIFDRLLFFWSDRRNPHE

SEQ ID NO: 27702 - protein, 148 aa, Homo sapiens
  ENSP00000446572
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKVGRARRPAAAAPAGTGGTRSPLYVDFPGP

SEQ ID NO: 27703 - protein, 543 aa, Homo sapiens
  ENSP00000239938
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 27704 - protein, 387 aa, Homo sapiens
  ENSP00000318057
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 27705 - protein, 349 aa, Homo sapiens
  ENSP00000430310
MEPCAAWSPRGGRENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 27706 - protein, 71 aa, Homo sapiens
  ENSP00000429370
MTGKLAEKLPVTMSSLLNQLPDNLYPEEIPSALNLFSGSSDSVVHYNQMATASHPGWSHVRRGVPAVGERM

SEQ ID NO: 27707 - protein, 535 aa, Homo sapiens
  ENSP00000327116
MFSWLGTDDRRRKDPEVFQTVSEGLKKLYKSKLLPLEEHYRFHEFHSPALEDADFDNKPMVLLVGQYSTGKTTFIRYLLEQDFPGMRIGPEPTTDSFIAVMQGDMEGIIPGNALVVDPKKPFRKLNAFGNAFLNRFVCAQLPNPVLESISVIDTPGILSGEKQRISRGYDFAAVLEWFAERVDRIILLFDAHKLDISDEFSEVIKALKNHEDKMRVVLNKADQIETQQLMRVYGALMWSLGKIVNTPEVIRVYIGSFWSHPLLIPDNRKLFEAEEQDLFRDIQSLPRNAALRKLNDLIKRARLAKVHAYIISSLKKEMPSVFGKDNKKKELVNNLAEIYGRIEREHQISPGDFPNLKRMQDQLQAQDFSKFQPLKSKLLEVVDDMLAHDIAQLMVLVRQEESQRPIQMVKGGAFEGTLHGPFGHGYGEGAGEGIDDAEWVVARDKPMYDEIFYTLSPVDGKITGANAKKEMVRSKLPNSVLGKIWKLADIDKDGMLDDDEFALANHLIKVKLEGHELPNELPAHLLPPSKRKVAE

SEQ ID NO: 27708 - protein, 965 aa, Homo sapiens
  ENSP00000408325
MIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 27709 - protein, 1116 aa, Homo sapiens
  ENSP00000307235
MERAISPGLLVRALLLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 27710 - protein, 956 aa, Homo sapiens
  ENSP00000412076
MCYSEGGWSTSGSRLQLLITIILLKVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVF

SEQ ID NO: 27711 - protein, 472 aa, Homo sapiens
  ENSP00000253039
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIAGNESCPQPQTSEHLAAIEIMKLKHILILQNKIDLVKESQAKEQYEQILAFVQGTVAEGAPIIPISAQLKYNIEVVCEYIVKKIPVPPRDFTSEPRLIVIRSFDVNKPGCEVDDLKGGVAGGSILKGVLKVGQEIEVRPGIVSKDSEGKLMCKPIFSKIVSLFAEHNDLQYAAPGGLIGVGTKIDPTLCRADRMVGQVLGAVGALPEIFTELEISYFLLRRLLGVRTEGDKKAAKVQKLSKNEVLMVNIGSLSTGGRVSAVKADLGKIVLTNPVCTEVGEKIALSRRVEKHWRLIGWGQIRRGVTIKPTVDDD

SEQ ID NO: 27712 - protein, 183 aa, Homo sapiens
  ENSP00000391383
  MOD_RES (1)..(1): Any amino acid
XAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRSCGSSTPDEFPTDIPGTKGNFKLVRHVSFVDCPGHDILMATMLNGAAVMDAALLLIGKYLTIGLDKSMWNKSKMKYLKGN

SEQ ID NO: 27713 - protein, 411 aa, Homo sapiens
  ENSP00000269349
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQVRETQALILAPTRELAVQIQKGLLALGDYMNVQCHACIGGTNVGEDIRKLDYGQHVVAGTPGRVFDMIRRRSLRTRAIKMLVLDEADEMLNKGFKEQIYDVYRYLPPATQVVLISATLPHEILEMTNKFMTDPIRILVKRDELTLEGIKQFFVAVEREEWKFDTLCDLYDTLTITQAVIFCNTKRKVDWLTEKMREANFTVSSMHGDMPQKERESIMKEFRSGASRVLISTDVWARGLDVPQVSLIINYDLPNNRELYIHRIGRSGRYGRKGVAINFVKNDDIRILRDIEQYYSTQIDEMPMNVADLI

SEQ ID NO: 27714 - protein, 125 aa, Homo sapiens
  ENSP00000460439
MATTATMATSGSARKRLLKEEDMTKVEFETSEEVDVTPTFDTMGLREDLLRGIYAYGFEKPSAIQQRAIKQIIKGRDVIAQSQSGTGKTATFSISVLQCLDIQGLLALGDYMNVQCHACIGGTNV

SEQ ID NO: 27715 - protein, 389 aa, Homo sapiens
  ENSP00000369453
MAVRLCDVASLLRSGSWAAEPWTGQVIAAMETQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKSRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 27716 - protein, 346 aa, Homo sapiens
  ENSP00000223951
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 27717 - protein, 359 aa, Homo sapiens
  ENSP00000369460
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQKPPGATEPITVKFANNPSQKTNQAILSQLYQSPNRRYPGPLAQQAQRFRLDNLLNMAYGVKRFSPMTIDGMTSLAGINIPGHPGTGWCIFVYNLAPDADESILWQMFGPFGAVTNVKVIRDFNTNKCKGFGFVTMTNYDEAAMAIASLNGYRLGDRVLQVSFKTNKTHKA

SEQ ID NO: 27718 - protein, 90 aa, Homo sapiens
  ENSP00000391757
MTQKELEQLFSQYGRIITSRILVDQVTGISRGVGFIRFDKRIEAEEAIKGLNGQKPPGATEPITVKFANNPSQKTNQAILSQLYQSPNRR

SEQ ID NO: 27719 - protein, 189 aa, Homo sapiens
  ENSP00000412602
METQLSNGPTCNNTANGPTTINNNCSSPVDSGNTEDSKTNLIVNYLPQNMTQEELKSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGISRGVGFIRFDKRIEAEEAIKGLNGQ

SEQ ID NO: 27720 - protein, 359 aa, Homo sapiens; identical to SEQ ID NO: 27717
  ENSP00000380479

SEQ ID NO: 27721 - protein, 359 aa, Homo sapiens; identical to SEQ ID NO: 27717
  ENSP00000440998

SEQ ID NO: 27722 - protein, 367 aa, Homo sapiens
  ENSP00000352162
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 27723 - protein, 360 aa, Homo sapiens
  ENSP00000390878
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKRFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 27724 - protein, 92 aa, Homo sapiens
  ENSP00000467314
MVTQILGAMESQVGGGPAGPALPNGPLLGTNGATDDSKTNLIVNYLPQNMTQDEFKSLFGSIGDIESCKLVRDKITDKAINTLNGLKLQTKT

SEQ ID NO: 27725 - protein, 366 aa, Homo sapiens
  ENSP00000360892
MEQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27726 - protein, 402 aa, Homo sapiens
  ENSP00000349594
MLRYLQPLGCVHGGKGLTDMRLLLLREIVINESRNCSFMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27727 - protein, 366 aa, Homo sapiens
  ENSP00000360889
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27728 - protein, 380 aa, Homo sapiens
  ENSP00000360888
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27729 - protein, 385 aa, Homo sapiens
  ENSP00000360886
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACPPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27730 - protein, 371 aa, Homo sapiens
  ENSP00000360884
MEWNGLKMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27731 - protein, 369 aa, Homo sapiens
  ENSP00000399939
MRLKNQIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 27732 - protein, 504 aa, Homo sapiens
  ENSP00000368867
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 27733 - protein, 593 aa, Homo sapiens
  ENSP00000368868
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 27734 - protein, 192 aa, Homo sapiens
  ENSP00000426087
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMP

SEQ ID NO: 27735 - protein, 93 aa, Homo sapiens
  ENSP00000421278
MTSAVVDSGGTILELSSNGVENQEESEKVSEYPAVIVEPVPSARLEQGYAAQVLVYDDETYMMQDVAEEQEVETENVETGGISLCHPGWSAVV

SEQ ID NO: 27736 - protein, 245 aa, Homo sapiens
  ENSP00000397796
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAA

SEQ ID NO: 27737 - protein, 521 aa, Homo sapiens
  ENSP00000426997
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 27738 - protein, 533 aa, Homo sapiens
  ENSP00000351458
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 27739 - protein, 581 aa, Homo sapiens
  ENSP00000377782
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 27740 - protein, 828 aa, Homo sapiens
  ENSP00000456548
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHYIMTILGCLFGMVLVLGAVYYCLRRRRRQEEKHKKAASAAAAGSLKKTIIELKYGPELEAPGLAPLSQGPLLGPEAVTRIPYLPAAGEVEQYKLVESADTPKASKGSYMEVRTGDPPERRDCELGRPGPDSQSSVAEISTIAKEVDKVNQIINNCIDALKSESTSFQGVKSGPVSVAEPPLVLLSEPLAAKHGFLAPGYKDAFGHSLQRHHSVEAAGPPRASTSSSGSVRSPRAFRAEAVGVHKAAAAEAKYIEKGSPAADAILTVTPAAAVLRAEAEKGRQYGEHRHSYPGSHPAEPPAPPGPPPPPPHEGLGRKASILEPLTRPRPRDLAYSQLSPQYHSLSYSSSPEYTCRASQSIWERFRLSRRRHKEEEEFMAAGHALRKKVQFAKDEDLHDILDYWKGVSAQHKS

SEQ ID NO: 27741 - protein, 828 aa, Homo sapiens; identical to SEQ ID NO: 27740
  ENSP00000457193

SEQ ID NO: 27742 - protein, 247 aa, Homo sapiens
  ENSP00000379360
MQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 27743 - protein, 727 aa, Homo sapiens
  ENSP00000312185
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 27744 - protein, 247 aa, Homo sapiens; identical to SEQ ID NO: 27742
  ENSP00000379355

SEQ ID NO: 27745 - protein, 727 aa, Homo sapiens; identical to SEQ ID NO: 27743
  ENSP00000406952

SEQ ID NO: 27746 - protein, 727 aa, Homo sapiens; identical to SEQ ID NO: 27743
  ENSP00000394458

SEQ ID NO: 27747 - protein, 182 aa, Homo sapiens
  ENSP00000396465
ANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELHHLSPEKFTLP

SEQ ID NO: 27748 - protein, 193 aa, Homo sapiens
  ENSP00000413108
  MOD_RES (1)..(1): Any amino acid
XQEIQTYTIAVINALFLKAPDERRQVDVESNVDILDCPLTEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPF

SEQ ID NO: 27749 - protein, 124 aa, Homo sapiens
  ENSP00000395933
QEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFIVSKLSPVCALPPASPGLTSAT

SEQ ID NO: 27750 - protein, 167 aa, Homo sapiens
  ENSP00000406610
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTDFGDMLSFTLTAFVELMDHGIVSWDTFSVA

SEQ ID NO: 27751 - protein, 149 aa, Homo sapiens
  ENSP00000416090
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKP

SEQ ID NO: 27752 - protein, 81 aa, Homo sapiens
  ENSP00000391734
MPPPADIVKVAIEWPGAYPKLMEIDQKKPLSAIIKEVCDGWSLANHEYFALQHADSSNFYITEKNRNEIKNGTILRLTTSP

SEQ ID NO: 27753 - protein, 59 aa, Homo sapiens
  ENSP00000397857
MPPPADIVKVAIEWPGAYPKLMEIDQKKPLSAIIKEVCDGWSLANHEYFALQHADSSNF

SEQ ID NO: 27754 - protein, 720 aa, Homo sapiens
  ENSP00000290246
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27755 - protein, 441 aa, Homo sapiens
  ENSP00000431972
  MOD_RES (1)..(1): Any amino acid
XPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKVSREASLSSWPSDTWRVPLVVVFSRCILGIFPSLFLNVLLRILNIHKNRWNLCIHITQTQQPWPVLPIHLFLSFIALKKVPSITLFHL

SEQ ID NO: 27756 - protein, 632 aa, Homo sapiens
  ENSP00000361249
MERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27757 - protein, 283 aa, Homo sapiens
  ENSP00000414329
YHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKNIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27758 - protein, 718 aa, Homo sapiens
  ENSP00000326172
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLELAFSILYDPDETLNFIAPNKYEYCIWIDGLSALLGKDMSSELTKSDLDTLLSMEMKLRLLDLENIQIPEAPPPIPKEPSSYDFVYHYG

SEQ ID NO: 27759 - protein, 267 aa, Homo sapiens
  ENSP00000388962
EEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 27760 - protein, 338 aa, Homo sapiens
  ENSP00000416181
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGT

SEQ ID NO: 27761 - protein, 720 aa, Homo sapiens; identical to SEQ ID NO: 27754
  ENSP00000379673

SEQ ID NO: 27762 - protein, 328 aa, Homo sapiens
  ENSP00000433232
MLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27763 - protein, 334 aa, Homo sapiens
  ENSP00000265840
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27764 - protein, 326 aa, Homo sapiens
  ENSP00000412257
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCSKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 27765 - protein, 706 aa, Homo sapiens
  ENSP00000389857
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27766 - protein, 724 aa, Homo sapiens
  ENSP00000252034
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27767 - protein, 151 aa, Homo sapiens
  ENSP00000394549
MAGLTAAAPRPGVLLLLLSILHPSRPGGVPGAIPGGVPGGVFYPALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGA

SEQ ID NO: 27768 - protein, 643 aa, Homo sapiens
  ENSP00000315607
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27769 - protein, 294 aa, Homo sapiens
  ENSP00000406949
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKY

SEQ ID NO: 27770 - protein, 168 aa, Homo sapiens
  ENSP00000389206
MAGLTAAAPRPGVLLLLLSILHPSRPGGVPGAIPGGVPGGVFYPGAGLGALGGGALGPGGKPLKPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAA

SEQ ID NO: 27771 - protein, 700 aa, Homo sapiens
  ENSP00000392575
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27772 - protein, 730 aa, Homo sapiens
  ENSP00000369936
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27773 - protein, 677 aa, Homo sapiens
  ENSP00000369949
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27774 - protein, 658 aa, Homo sapiens
  ENSP00000369958
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27775 - protein, 714 aa, Homo sapiens
  ENSP00000403162
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27776 - protein, 711 aa, Homo sapiens
  ENSP00000349540
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27777 - protein, 214 aa, Homo sapiens
  ENSP00000411092
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGT

SEQ ID NO: 27778 - protein, 692 aa, Homo sapiens
  ENSP00000391129
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27779 - protein, 68 aa, Homo sapiens
  ENSP00000404138
MAGLTAAAPRPGVLLLLLSILHPSRPGGVPGAIPGGVPGGVFYPGNVHETSTHPGHADDADVHNRCTF

SEQ ID NO: 27780 - protein, 176 aa, Homo sapiens
  ENSP00000403961
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGGAFAGIPGVGPFGGPQPGVPLGYPIKAPKLP

SEQ ID NO: 27781 - protein, 570 aa, Homo sapiens
  ENSP00000369926
MAGLTAAAPRPGVLLLLLSILHPSRPGGVPGAIPGGVPGGVFYPGAGLGALGGGALGPGGKPLKPVPGGLAGAGLGAGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27782 - protein, 705 aa, Homo sapiens
  ENSP00000369950
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27783 - protein, 166 aa, Homo sapiens
  ENSP00000399499
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGVGPFGGPQPGVPLGYPIKAPKLPGGYGLPYTTGKLPYGYGPGGVAGAAGKAGYPTGT

SEQ ID NO: 27784 - protein, 757 aa, Homo sapiens
  ENSP00000313565
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27785 - protein, 60 aa, Homo sapiens
  ENSP00000412262
VTFPGALVPGGVADAAAAYKAAKAGAGLGGVPGVGGLGVSAGAVVPQPGAGVKPGKVPAL

SEQ ID NO: 27786 - protein, 617 aa, Homo sapiens
  ENSP00000480955
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 27787 - protein, 786 aa, Homo sapiens
  ENSP00000351807
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 27788 - protein, 279 aa, Homo sapiens
  ENSP00000361536
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 27789 - protein, 279 aa, Homo sapiens; identical to SEQ ID NO: 27788
  ENSP00000477602

SEQ ID NO: 27790 - protein, 252 aa, Homo sapiens
  ENSP00000416024
MEAVVNLYQEVMKHADPRIQGYPLMGSPLLMTSILLTYVYFVLSLGPRIMANRKPFQLRGFMIVYNFSLVALSLYIVYEMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 27791 - protein, 296 aa, Homo sapiens
  ENSP00000346693
MEHLKAFDDEINAFLDNMFGPRDSRVRGWFMLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFIHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 27792 - protein, 299 aa, Homo sapiens
  ENSP00000306640
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 27793 - protein, 88 aa, Homo sapiens
  ENSP00000359951
MEHFDASLSTYFKALLGPRGISSSVLRMGPPLHTVVGWLQQLQAAHSEEEEKMFHLCGFKHKEVVSQSSLPAVIPQNSLATIASHAPA

SEQ ID NO: 27794 - protein, 326 aa, Homo sapiens
  ENSP00000359956
MEHFDASLSTYFKALLGPRDTRVKGWFLLDNYIPTFICSVIYLLIVWLGPKYMRNKQPFSCRGILVVYNLGLTLLSLYMFCESKREQPRRSACASRTDPSTQQQLPENRLVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 27795 - protein, 262 aa, Homo sapiens
  ENSP00000440728
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSSVCADNHPDQLRGHLAVHIPSWLVVFPDWIHDFPDCSLHKLLHSDLQQERGLPKERPPEGPPEWVHGCCEWTHQQLFTPGKQCEAKEAAEGLKSKN

SEQ ID NO: 27796 - protein, 281 aa, Homo sapiens
  ENSP00000424123
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 27797 - protein, 268 aa, Homo sapiens
  ENSP00000421043
MEKPINILYPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 27798 - protein, 71 aa, Homo sapiens
  ENSP00000425127
MAFSDLTSRTVHLYDNWIKDADPRVEDWLLMSSPLPQTILLGFYVYFVTSLGPKLMENRKPFELKKAMITL

SEQ ID NO: 27799 - protein, 165 aa, Homo sapiens
  ENSP00000424081
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFA

SEQ ID NO: 27800 - protein, 165 aa, Homo sapiens; identical to SEQ ID NO: 27799
  ENSP00000426400

SEQ ID NO: 27801 - protein, 88 aa, Homo sapiens
  ENSP00000422602
MAFSDLTSRTVHLYDNWIKDADPRVEDWLLMSSPLPQTILLGFYVYFVTSLGPKLMENRKPFELKKAMITYNFFIVLFSVYMCYEILF

SEQ ID NO: 27802 - protein, 281 aa, Homo sapiens; identical to SEQ ID NO: 27796
  ENSP00000402634

SEQ ID NO: 27803 - protein, 379 aa, Homo sapiens
  ENSP00000457353
MARVGPGRAGVSCQGRGRGRGGSGQRRPPTWEISDSDAEDSAGSEAAARARDPAGERRAAAEALRLLRPEQVLKRLAVCVDTAILEDAGADVLMEALEALGCECRIEPQRPARSLRWTRASPDPCPRSLPPEVWAAGEQELLLLLEPEEFLQGVATLTQISGPTHWVPWISPETTARPHLAVIGLDAYLWSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 27804 - protein, 190 aa, Homo sapiens
  ENSP00000457966
  MOD_RES (1)..(1): Any amino acid
XSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 27805 - protein, 115 aa, Homo sapiens
  ENSP00000456946
  MOD_RES (1)..(1): Any amino acid
XQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 27806 - protein, 1053 aa, Homo sapiens
  ENSP00000254528
MWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 27807 - protein, 1977 aa, Homo sapiens
  ENSP00000451998
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERQGVVRGSRPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 27808 - protein, 60 aa, Homo sapiens
  ENSP00000450965
ISDIRFSPGSGKYLAVASHDSFIDIYNVMSSKRVGICKGATSYITHIDWDIRAFTGQHWC

SEQ ID NO: 27809 - protein, 1969 aa, Homo sapiens
  ENSP00000370039
MAARSAPSCHLRLEWVYGYRGHQCRNNLYYTAAKEIVYFVAGVGVVYSPREHRQKFYRGHSDDIISLALHPERVLVATGQVGKEPYICIWDSYTVQTISVLKDVHTHGIACLAFDLDGQRLVSVGLDSKNAVCVWDWKRGKMLSMAPGHTDRIFDISWDLYQPNKLVSCGVKHIKFWSLCGNALTPKRGVFGKTGDLQTILCLACARDELTYSGALNGDIYVWKGINLIRTIQGAHAAGIFSMNACEEGFATGGRDGCIRLWDLTFKPITVIDLRETDQGYKGLSVRSVCWRGDHILVGTQDSEIFEIVVQERNKPFLIMQGHCEGELWALAVHPTKPLAVTGSDDRSVRIWSLVDHALIARCNMEEPIRCAAVNADGIHLALGMKDGSFTVLRVRDMTEVVHIKDRKEAIHELKYSPDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGLNDGSFLMANADTLEDLVSFHHRKDMISDIRFSPGSGKYLAVASHDSFIDIYNVMSSKRVGICKGATSYITHIDWDIRGKLLQVNTGAKEQLFFEAPRGKKQTIPSVEVEKIAWASWTSVLGLCCEGIWPVIGEVTDVTASCLTSDKMVLATGDDLGFVKLFRYPTKGKFGKFKRYVAHSTHVTNVRWTYDDSMLVTLGGTDMSLMVWTNEMEGYREKRPCDSEESDIDSEEDGGYDSDVTRENEISYTIRALSTNIRPMLGIKPHLQQKEPSIDERPPVSRAPPQPEKLQTNNVGKKKRPIEDLVLELIFGYRGRDCRNNVHYLNDGDDIIYHTASVGILHNVATGSQSFYQEHNDDILCLTVNQHPKFINIVATGQVGDSADMSATAPSIHIWDAMNKQTLSILRCYHSKGVCSVSFSATGKLLLSVGLDPEHTITIWRWQEGAKIASRAGHNQRIFVAEFRPDSDTQFVSVGVKHVKFWTLAGRALLSKKGLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKKMLNKVNLGHAARTVCYSPEGDMVAIGMKNGEFIILLVSSLKIWGKKRDRRCAIHDIRFSPDSRYLAVGSSENSVDFYDLTLGPTLNRISYCKDIPSFVIQMDFSADSSYLQVSSGCYKRHVYEVPSGKHLMDHAAIDRITWATWTSILGDEVLGIWSRHAEKADVNCACVSHSGISLVTGDDFGMVKLFDFPCPEKFAKHKRFLGHSPHVTNIRFTSGDRHVVSAGGDDCSLFVWKCVHTPH

SEQ ID NO: 27810 - protein, 256 aa, Homo sapiens
  ENSP00000452030
GLLSTLEDARMQTMLAIAFGANNLTFTGTISGDVCVWKDHILCRIVARAHNGPVFAMYTTLRDGLIVTGGKERPSKEGGAVKLWDQELRRCRAFRLETGQATDCVRSVCRGKGKILVGTRNAEIIEVGEKNAACNILVNGHVDGPIWGLATHPSRDFFLSAAEDGTVRLWDIADKMLNKVNLGHAARTVCYSPEGDMVAIGMKNGEFIILLVSSLKIWGKKRDRRCAIHDIRISYCKDIPSFVIQMDFSADSSYLQ

SEQ ID NO: 27811 - protein, 205 aa, Homo sapiens
  ENSP00000452360
  MOD_RES (1)..(1): Any amino acid
XDGTYLAVGCNDSSVDIYGVAQRYKKVGECLGSLSFITHLDWSSDSRYLQTNDGNGKRLFYRMPGGKEVTSTEEIKGVHWASWTCVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQGYIHLYLHRHLNLM

SEQ ID NO: 27812 - protein, 167 aa, Homo sapiens
  ENSP00000352540
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 27813 - protein, 167 aa, Homo sapiens; identical to SEQ ID NO: 27812
  ENSP00000445712

SEQ ID NO: 27814 - protein, 333 aa, Homo sapiens
  ENSP00000297375
MEENDPKPGEAAAAVEGQRQPESSPGGGSGGGGGSSPGEADTGRRRALMLPAVLQAPGNHQHPHRITNFFIDNILRPEFGRRKDAGTCCAGAGGGRGGGAGGEGGASGAEGGGGAGGSEQLLGSGSREPRQNPPCAPGAGGPLPAAGSDSPGDGEGGSKTLSLHGGAKKGGDPGGPLDGSLKARGLGGGDLSVSSDSDSSQAGANLGAQPMLWPAWVYCTRYSDRPSSGPRSRKPKKKNPNKEDKRPRTAFTAEQLQRLKAEFQTNRYLTEQRRQSLAQELSLNESQIKIWFQNKRAKIKKATGNKNTLAVHLMAQGLYNHSTTAKEGKSDSE

SEQ ID NO: 27815 - protein, 591 aa, Homo sapiens
  ENSP00000355809
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRRDSPRKNQIVFDNRSYDSLHRPKSTPLSQPSANGVQTEGLDYDRLKQDILDEMRKELTKLKEELIDAIRQELSKSNTA

SEQ ID NO: 27816 - protein, 802 aa, Homo sapiens
  ENSP00000489607
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETVFYLGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAPSSDSSLYNAPLPEYSSCQPPSAPPPSYAKVISAPVSDATPDYAVVTALPPTSTPPTPPLRHSATRFATSLGSAFHPVLPHYATVPRPLNKNSRPSSPVNTPSSQPPATKPCAWSTSNFSPLPPSPPIMISSPPGKATGPRPVLPVCVSSPVPQMPPSPTAPNGLVDSVTYPVSPPPTSGPAAPPPPPPLPSLASLSHCGSQASPPPSTPIASTPSSKPSVLPSPSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 27817 - protein, 570 aa, Homo sapiens
  ENSP00000355808
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAAAPASVETPLNSVLGDSSASEPGLQAASQPAETPSQQGIVLGPLAPPPPPPLPPGPAQASVALPPPPGPPPPPPLPSTGPPPPPPPPPLPNQVPPPPPPPPAPPLPASGFFLASMSEDNRPLTGLAAAIAGAKLRKVSRMEDTSFPSGGNAIGVNSASSKTDTGRGNGPLPLGGSGLMEEMSALLARRRRIAEKGSTIETEQKEDKGEDSEPVTSKASSTSTPEPTRKPWERTNTMNGSKSPVISRPKSTPLSQPSANGVQTEGLDYDRLKQDILDEMRKELTKLKEELIDAIRQELSKSNTA

SEQ ID NO: 27818 - protein, 242 aa, Homo sapiens
  ENSP00000489106
  MOD_RES (1)..(1): Any amino acid
XRKIQDHQVVINCAIPKGLKYNQATQTFHQWRDARQVYGLNFGSKEDANVFASAMMHALEVLNSQETGPTLPRQNSQLPAQVQNGPSQEELEIQRRQLQEQQRQKELERERLERERMERERLERERLERERLERERLEQEQLERERQERERQERLERQERLERQERLERQERLDRERQERQERERLERLERERQERERQEQLEREQLEWERERRISSAGKKFTNSSVFLYLSLDDVSCAVMC

SEQ ID NO: 27819 - protein, 213 aa, Homo sapiens
  ENSP00000284563
MSEQSICQARAAVMVYDDANKKWVPAGGSTGFSRVHIYHHTGNNTFRVVGRKIQDHQVVINCAIPKGLKYNQATQTFHQWRDARQVYGLNFGSKEDANVFASAMMHALEVLNSQETAQSKVTATQDSTNLRCIFCGPTLPRQNSQLPAQVQNGPSQEELEIQRRQLQEQQRQKELERERLERERMERERLERERLERERLERERLEQEQLERE

SEQ ID NO: 27820 - protein, 589 aa, Homo sapiens
  ENSP00000306356
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 27821 - protein, 516 aa, Homo sapiens
  ENSP00000423804
MFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 27822 - protein, 49 aa, Homo sapiens
  ENSP00000422943
MSVSVHENRKSRASSGSINIYLFHKSSYADSVLTHLNLLRQQRLFTDVL

SEQ ID NO: 27823 - protein, 4 aa, Homo sapiens
  ENSP00000426889
MSVS

SEQ ID NO: 27824 - protein, 589 aa, Homo sapiens; identical to SEQ ID NO: 27820
  ENSP00000446289

SEQ ID NO: 27825 - protein, 589 aa, Homo sapiens; identical to SEQ ID NO: 27820
  ENSP00000479101

SEQ ID NO: 27826 - protein, 643 aa, Homo sapiens
  ENSP00000261488
MVDAGGVENITQLPQELPQMMAAAADGLGSIAIDTTQLNMSVTDPTAWATAMNNLGMVPVGLPGQQLVSDSICVPGFDPSLNMMTGITPINPMIPGLGLVPPPPPTEVAVVKEIIHCKSCTLFPQNPNLPPPSTRERPPGCKTVFVGGLPENATEEIIQEVFEQCGDITAIRKSKKNFCHIRFAEEFMVDKAIYLSGYRMRLGSSTDKKDSGRLHVDFAQARDDFYEWECKQRMRAREERHRRKLEEDRLRPPSPPAIMHYSEHEAALLAEKLKDDSKFSEAITVLLSWIERGEVNRRSANQFYSMVQSANSHVRRLMNEKATHEQEMEEAKENFKNALTGILTQFEQIVAVFNASTRQKAWDHFSKAQRKNIDIWRKHSEELRNAQSEQLMGIRREEEMEMSDDENCDSPTKKMRVDESALAAQAYALKEENDSLRWQLDAYRNEVELLKQEKEQLFRTEENLTKDQQLQFLQQTMQGMQQQLLTIQEELNNKKSELEQAKEEQSHTQALLKVLQEQLKGTKELVETNGHSHEDSNEINVLTVALVNQDRENNIEKRSQGLKSEKEALLIGIISTFLHVHPFGANIEYLWSYMQQLDSKISANEIEMLLMRLPRMFKQEFTGVGATLEKRWKLCAFEGIKTT

SEQ ID NO: 27827 - protein, 925 aa, Homo sapiens
  ENSP00000354238
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 27828 - protein, 378 aa, Homo sapiens
  ENSP00000422424
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERRTRFFRSFIWTSQQ

SEQ ID NO: 27829 - protein, 915 aa, Homo sapiens
  ENSP00000259486
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEESSYGSPFTPAKRPKRKVAPKRRQERPVAPPKKRRRKIHRMDHYAAETRQDKMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 27830 - protein, 884 aa, Homo sapiens
  ENSP00000403315
MTRHADRIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 27831 - protein, 498 aa, Homo sapiens
  ENSP00000429476
MEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 27832 - protein, 888 aa, Homo sapiens
  ENSP00000428291
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEAETRKFRGSRNENKENINGNFEPRKERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 27833 - protein, 863 aa, Homo sapiens
  ENSP00000075322
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 27834 - protein, 245 aa, Homo sapiens
  ENSP00000428304
MARRSSFQSCQIISLFTFAVGVNICLGFTAHRIKRAEGWEEGPPTVLSDSPWTNISGSCKGRCFELQEAGPPDCRCDNLSRGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPVSFA

SEQ ID NO: 27835 - protein, 162 aa, Homo sapiens
  ENSP00000429447
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGGP

SEQ ID NO: 27836 - protein, 453 aa, Homo sapiens
  ENSP00000318066
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 27837 - protein, 440 aa, Homo sapiens
  ENSP00000296741
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 27838 - protein, 194 aa, Homo sapiens
  ENSP00000423497
MIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGK

SEQ ID NO: 27839 - protein, 495 aa, Homo sapiens
  ENSP00000347213
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 27840 - protein, 472 aa, Homo sapiens
  ENSP00000312494
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 27841 - protein, 779 aa, Homo sapiens
  ENSP00000202028
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27842 - protein, 37 aa, Homo sapiens
  ENSP00000393106
MEEKDYSEADGLSERTTPSKAQKSPQKIAKKYKSAIC

SEQ ID NO: 27843 - protein, 168 aa, Homo sapiens
  ENSP00000385244
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWN

SEQ ID NO: 27844 - protein, 257 aa, Homo sapiens
  ENSP00000404341
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRF

SEQ ID NO: 27845 - protein, 772 aa, Homo sapiens
  ENSP00000363061
MEEKDYSEADGLSERTTPSKAQKSPQKIAKKYKSAICRVTLLDASEYECEVENWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27846 - protein, 701 aa, Homo sapiens
  ENSP00000487049
MVFLGRINEVEPAKGLAESLAPTERSVKSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27847 - protein, 188 aa, Homo sapiens
  ENSP00000413262
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDIT

SEQ ID NO: 27848 - protein, 114 aa, Homo sapiens
  ENSP00000396366
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVE

SEQ ID NO: 27849 - protein, 59 aa, Homo sapiens
  ENSP00000408877
MTTETGPDSEVKKAQEEAPQQPEAAAAVTTPVTPAGHGHPEANSNEKHPSQQDTRPAEQ

SEQ ID NO: 27850 - protein, 199 aa, Homo sapiens
  ENSP00000363056
MEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTY

SEQ ID NO: 27851 - protein, 881 aa, Homo sapiens
  ENSP00000337168
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27852 - protein, 880 aa, Homo sapiens
  ENSP00000363052
MTTETGPDSEVKKAQEEAPQQPEAAAAVTTPVTPAGHGHPEANSNEKHPSQQDTRPAEQSLDMEEKDYSEADGLSERTTPSKAQKSPQKIAKKYKSAICRVTLLDASEYECEVEKHGRGQVLFDLVCEHLNLLEKDYFGLTFCDADSQKNWLDPSKEIKKQIRSSPWNFAFTVKFYPPDPAQLTEDITRYYLCLQLRADIITGRLPCSFVTHALLGSYAVQAELGDYDAEEHVGNYVSELRFAPNQTRELEERIMELHKTYRGMTPGEAEIHFLENAKKLSMYGVDLHHAKDSEGIDIMLGVCANGLLIYRDRLRINRFAWPKILKISYKRSNFYIKIRPGEYEQFESTIGFKLPNHRSAKRLWKVCIEHHTFFRLVSPEPPPKGFLVMGSKFRYSGRTQAQTRQASALIDRPAPFFERSSSKRYTMSRSLDGAEFSRPASVSENHDAGPDGDKRDEDGESGGQRSEAEEGEVRTPTKIKELKPEQETTPRHKQEFLDKPEDVLLKHQASINELKRTLKEPNSKLIHRDRDWERERRLPSSPASPSPKGTPEKANERAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27853 - protein, 268 aa, Homo sapiens
  ENSP00000406464
  MOD_RES (1)..(1): Any amino acid
XRYTMSRSLDGAEFSRPASVSENHDAGPDGDKRDEDGESGGQRSEAEEGEVRTPTKIKELKFLDKPEDVLLKHQASINELKRTLKEPNSKLIHRDRDWERERRLPSSPASPSPKGTPEKANEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQ

SEQ ID NO: 27854 - protein, 197 aa, Homo sapiens
  ENSP00000388281
VLLKHQASINELKRTLKEPNSKLIHRDRDWERERRLPSSPASPSPKGTPEKANEPVKTETMTVSSLAIRKKIEPEAVLQTRVSAMDNTQQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDV

SEQ ID NO: 27855 - protein, 1068 aa, Homo sapiens
  ENSP00000489867
  MOD_RES (1)..(1): Any amino acid
XDRDWERERRLPSSPASPSPKGTPEKANESQRTQDISQRDLVPEPGAAAGLEVFTQKSLAASPEGSEHWVFIEREYTRPEELGLLKVTTMQQEERQAGLAGILANGRLSKVDVLVDKFKVEVATEEMVGNRRANTQQQGKMIASPEDFESVGEEGPWIRESPGGAALASGRTLAEKLLEGSELRADTREATIRNRCMSDGQPEGQTELRKGLEEPHTCGRPTAPGTRPAEVDVLSPASDKGGLQSFLLDPAHAEARAELSNETDTSFAERSFYLNYEEKDSEDQVLPPPLEERKGRLDAPPGGEPRPTLNSLDLRVSAAASSRSKDEAHMTSPKEGAGTPKNHGGPGDLKGSPAGQTFAEGWEDAQWGVEGEFPHLTASAAREEGTPVSGDLLGKAEESPTEELKKHPPHRGQGVHPDPQACALPRAIPLNVRKPVKPDRGNFPPKERGVVPTQKGGAELKDREASAFLHMEVIIPLPASPGHSEDLAALEEASPSPTSHGSGEPSELREPFLRHVHLSKASPEPKDQVGFVVSPATGGERRPPPITSRKPRVVPEEAEGRIPLGFGFPSGKRREMTSFQAGDQEGSLEDISKTSVANKIRIFETHGAETRRMSEGEARSLPNDVSSEAPVGQAEQQRSTLSDLGFAQLQPPGDFASPKATHSTVIPLATRHFREDTSASYQEAHTELEPVSPNSGCETTLAEATGTGNKSGDAVREEKRSTNLAANTPGKGGRLRFASPSGPQRAGLREGSEEKVKPPRPRAPESDTGDEDQDQERDTVFLKDNHLAIERKCSSITVSSTSSLEAEVDFTVIGDYHGSAFEDFSRSLPELDRDKSDSDTEGLLFSRDLNKGAPSQDDESGGIEDSPDRGACSTPDMPQFEPVKTETMTVSSLAIRKKIEPEAVLQTRVSAMDNTQVDGSASVGREFIATTPSITTETISTTMENSLKSGKGAAAMIPGPQTVATEIRSLSPIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27856 - protein, 119 aa, Homo sapiens
  ENSP00000390262
  MOD_RES (1)..(1): Any amino acid
XSVGREFIATTPSITTETISTTMIIGKDVLTSTYGATAETLSTSTTTHVTKTVKGGFSETRIEKRIIITGDEDVDQDQALALAIKEAKLQHPDMLVTKAVVYRETDPSPEERDKKPQES

SEQ ID NO: 27857 - protein, 779 aa, Homo sapiens; identical to SEQ ID NO: 27841
  ENSP00000399214

SEQ ID NO: 27858 - protein, 880 aa, Homo sapiens; identical to SEQ ID NO: 27852
  ENSP00000363057

SEQ ID NO: 27859 - protein, 900 aa, Homo sapiens
  ENSP00000363694
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMNPFPDTFTTGPQFTADFRDSKLQCCPGPTSPLIPAATLRPLTETVSTVQTIYTTRKPVSLAASAETLRQELEREKMMKRLLMTEL

SEQ ID NO: 27860 - protein, 518 aa, Homo sapiens
  ENSP00000363685
MLRFLRRTFGRRSMQRYARGAAGRGAAGLGDERDGGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 27861 - protein, 983 aa, Homo sapiens
  ENSP00000337451
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 27862 - protein, 539 aa, Homo sapiens
  ENSP00000399926
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 27863 - protein, 918 aa, Homo sapiens
  ENSP00000419190
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTVT

SEQ ID NO: 27864 - protein, 949 aa, Homo sapiens
  ENSP00000386276
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQE

SEQ ID NO: 27865 - protein, 986 aa, Homo sapiens
  ENSP00000386829
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 27866 - protein, 37 aa, Homo sapiens
  ENSP00000408145
AYRKFTSASDVWSYGIVMWEVMSYGERPYWDMSNQDT

SEQ ID NO: 27867 - protein, 177 aa, Homo sapiens
  ENSP00000395917
MAGIFYFALFSCLFGICDAVTGSRVYPANEGPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILE

SEQ ID NO: 27868 - protein, 188 aa, Homo sapiens
  ENSP00000401405
  MOD_RES (1)..(1): Any amino acid
XFHGSLSSTHFTCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKE

SEQ ID NO: 27869 - protein, 38 aa, Homo sapiens
  ENSP00000391517
MAGIFYFALFSCLFGICDAVTGSRVYPANEVGGSEYHG

SEQ ID NO: 27870 - protein, 126 aa, Homo sapiens
  ENSP00000410158
MDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAF

SEQ ID NO: 27871 - protein, 149 aa, Homo sapiens
  ENSP00000444085
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIA

SEQ ID NO: 27872 - protein, 91 aa, Homo sapiens
  ENSP00000404089
MAGIFYFALFSCLFGICDAVTGSRVYPANEVTLLDSRSVQGELGWIASPLEGGWEEVSIMDEKNTPIRTYQVCNVMEPSQNNWLRTDWITR

SEQ ID NO: 27873 - protein, 986 aa, Homo sapiens; identical to SEQ ID NO: 27865
  ENSP00000281821

SEQ ID NO: 27874 - protein, 547 aa, Homo sapiens
  ENSP00000420598
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDGKFHCCSLKTDP

SEQ ID NO: 27875 - protein, 1130 aa, Homo sapiens
  ENSP00000374323
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVMPESPGEVPEYPLFVTVGDWLDSIKMGQYKNNFVAAGFTTFDLISRMSIDDIRRIGVILIGHQRRIVSSIQTLRLHMMHIQEKGFHV

SEQ ID NO: 27876 - protein, 324 aa, Homo sapiens
  ENSP00000425132
  MOD_RES (1)..(1): Any amino acid
XEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHGASKGRCF

SEQ ID NO: 27877 - protein, 208 aa, Homo sapiens
  ENSP00000421260
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKKPLEMMTYILRAKGEAGFLKK

SEQ ID NO: 27878 - protein, 373 aa, Homo sapiens
  ENSP00000419470
MAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKSRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVSNHESF

SEQ ID NO: 27879 - protein, 398 aa, Homo sapiens
  ENSP00000421711
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTRPTNHNKEQSELVKEDGLESLCEQCESSSGYGTGLVLMWKRNRRAMGASGQTRKQCDKRDNPPTDLFQTLTLNLCYSA

SEQ ID NO: 27880 - protein, 241 aa, Homo sapiens
  ENSP00000424638
MAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRLYPKAEYNGKQCSRYSI

SEQ ID NO: 27881 - protein, 334 aa, Homo sapiens
  ENSP00000423950
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 27882 - protein, 55 aa, Homo sapiens
  ENSP00000421353
FVAAGFTTFDLISRMSIDDIRRIGVILIGHQRRIVSSIQTLRLHMMHIQEKGFHV

SEQ ID NO: 27883 - protein, 112 aa, Homo sapiens
  ENSP00000417435
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPY

SEQ ID NO: 27884 - protein, 281 aa, Homo sapiens
  ENSP00000420338
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKVSRPFWRILRQQD

SEQ ID NO: 27885 - protein, 984 aa, Homo sapiens
  ENSP00000381097
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 27886 - protein, 42 aa, Homo sapiens
  ENSP00000419688
MDTRTATAELGWTANPASGWEEVSGYDENLNTIRTYQVCNVF

SEQ ID NO: 27887 - protein, 102 aa, Homo sapiens
  ENSP00000417216
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATK

SEQ ID NO: 27888 - protein, 149 aa, Homo sapiens
  ENSP00000418352
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRN

SEQ ID NO: 27889 - protein, 545 aa, Homo sapiens
  ENSP00000419574
MHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 27890 - protein, 935 aa, Homo sapiens
  ENSP00000353833
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGDLLRIGVTLAGHQKKILASVQHMKSQAKPGTPGGTGGPAPQY

SEQ ID NO: 27891 - protein, 987 aa, Homo sapiens
  ENSP00000350896
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 27892 - protein, 306 aa, Homo sapiens
  ENSP00000482702
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRGRRGSQQRAVPEDVRKPGRAAGAEAGSQLPGAGTGAL

SEQ ID NO: 27893 - protein, 576 aa, Homo sapiens
  ENSP00000270460
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQPPSCGPEDDAQLQLALSLSREEHDKEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27894 - protein, 550 aa, Homo sapiens
  ENSP00000085079
MSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27895 - protein, 662 aa, Homo sapiens
  ENSP00000406209
MGDQSWLWNQAAPGVRSPVFACSVEKGNVPLVLSEHLAHSRDPGSGAVRFLISPEPWASAILGTSGLLASPVLPAALDAVTCQHLPQPSSGSRPISPRIGALCPLLLQPGTMSTSSLRRQMKNIVHNYSEAEIKVREATSNDPWGPSSSLMSEIADLTYNVVAFSEIMSMIWKRLNDHGKNWRHVYKAMTLMEYLIKTGSERVSQQCKENMYAVQTLKDFQYVDRDGKDQGVNVREKAKQLVALLRDEDRLREERAHALKTKEKLAQTATASSAAVGSGPPPEAEQAWPQSSGEEELQLQLALAMSKEEADQEERIRRGDDLRLQMAIEESKRETGGKEESSLMDLADVFTAPAPAPTTDPWGGPAPMAAAVPTAAPTSDPWGGPPVPPAADPWGGPAPTPASGDPWRPAAPAGPSVDPWGGTPAPAAGEGPTPDPWGSSDGGVPVSGPSASDPWTPAPAFSDPWGGSPAKPSTNGTTAAGGFDTEPDEFSDFDRLRTALPTSGSSAGELELLAGEVPARSPGAFDMSGVRGSLAEAVGSPPPAATPTPTPPTRKTPESFLGPNAALVDLDSLVSRPGPTPPGAKASNPFLPGGGPATGPSVTNPFQPAPPATLTLNQLRLSPVPPVPGAPPTYISPLGGGPGLPPMMPPGPPAPNTNPFLL

SEQ ID NO: 27896 - protein, 60 aa, Homo sapiens
  ENSP00000466593
  MOD_RES (1)..(1): Any amino acid
XKPSTNGTTAAGGFDTEPDEFSDFDRLRTALPTSGSSAAYWTRLPPGFYSLNSYRSCFIR

SEQ ID NO: 27897 - protein, 762 aa, Homo sapiens
  ENSP00000360795
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 27898 - protein, 896 aa, Homo sapiens
  ENSP00000360798
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 27899 - protein, 90 aa, Homo sapiens
  ENSP00000474739
  MOD_RES (1)..(1): Any amino acid
XAAAQLSLTQLSSGNPVYEKYYRQVDTGNTGRVLASDAAAFLKKSGLPDLILGKIWDLADTDGKGILNKQHDTSSPLLISGTSAAELPWA

SEQ ID NO: 27900 - protein, 126 aa, Homo sapiens
  ENSP00000448636
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTN

SEQ ID NO: 27901 - protein, 116 aa, Homo sapiens
  ENSP00000449138
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIV

SEQ ID NO: 27902 - protein, 1342 aa, Homo sapiens
  ENSP00000267101
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 27903 - protein, 183 aa, Homo sapiens
  ENSP00000415753
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 27904 - protein, 43 aa, Homo sapiens
  ENSP00000448671
MRANDALQVPRAQSTSTQMFRMNVGPAMRTAPRGVKDQSFKTV

SEQ ID NO: 27905 - protein, 921 aa, Homo sapiens
  ENSP00000448483
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 27906 - protein, 331 aa, Homo sapiens
  ENSP00000447510
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKAF

SEQ ID NO: 27907 - protein, 115 aa, Homo sapiens
  ENSP00000449713
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEI

SEQ ID NO: 27908 - protein, 1283 aa, Homo sapiens
  ENSP00000408340
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 27909 - protein, 81 aa, Homo sapiens
  ENSP00000482073
LDIKHNRPRRDCVAEGKVCDPLCSSGGCWGPGPGQCLSCRNYSRGGVCVTHCNFLNGYSKGSQSRMGGGGALQWNCSGGIQ

SEQ ID NO: 27910 - protein, 649 aa, Homo sapiens
  ENSP00000448946
CLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 27911 - protein, 583 aa, Homo sapiens
  ENSP00000449129
MLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 27912 - protein, 462 aa, Homo sapiens
  ENSP00000448729
MPMSTILPVTSPCLPATGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 27913 - protein, 1308 aa, Homo sapiens
  ENSP00000342235
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 27914 - protein, 1292 aa, Homo sapiens
  ENSP00000403204
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 27915 - protein, 731 aa, Homo sapiens
  ENSP00000260943
  MOD_RES (1)..(1): Any amino acid
XKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCIGSSIEDCIGLMDRTPLIAAGVIGGLFILVIVGLTFAVYVRRKSIKKKRALRRFLETELVEPLTPSGTAPNQAQLRILKETELKRVKVLGSGAFGTVYKGIWVPEG

SEQ ID NO: 27916 - protein, 128 aa, Homo sapiens
  ENSP00000405564
MGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCG

SEQ ID NO: 27917 - protein, 1266 aa, Homo sapiens [sequence omitted]

SEQ ID NO: 27918 - protein, 1412 aa, Homo sapiens
  ENSP00000284037
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27919 - protein, 1371 aa, Homo sapiens
  ENSP00000370330
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27920 - protein, 610 aa, Homo sapiens
  ENSP00000397833
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSMLSRSFNSNFTTVSSFHCGSSRDLHGSQGSLALSVADRRGSGGHIFRMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27921 - protein, 1346 aa, Homo sapiens
  ENSP00000370325
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDANGYSFINIEHGQAVSLLKTFQNTVELIIVREVSS

SEQ ID NO: 27922 - protein, 1367 aa, Homo sapiens
  ENSP00000422766
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27923 - protein, 1419 aa, Homo sapiens
  ENSP00000426632
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKSMLSRSFNSNFTTVSSFHCGSSRDLHGSQGSLALSVADRRGSGGHIFRMPLSNGQMGQPLRPQANYSQIHHPPQASVARHPSREQLIDYLMLKVAHQPPYTQPHCSPRQGHELAKQEIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27924 - protein, 1302 aa, Homo sapiens
  ENSP00000422015
MTTKRSLFVRLVPCRCLRGEEETVTTLDYSHCSLEQVPKEIFTFEKTLEELYLDANQIEELPKQLFNCQSLHKLSLPDNDLTTLPASIANLINLRELDVSKNGIQEFPENIKNCKVLTIVEASVNPISKLPDGFSQLLNLTQLYLNDAFLEFLPANFGRLTKLQILELRENQLKMLPKTMNRLTQLERLDLGSNEFTEVPEVLEQLSGLKEFWMDANRLTFIPGFIGSLKQLTYLDVSKNNIEMVEEGISTCENLQDLLLSSNSLQQLPETIGSLKNITTLKIDENQLMYLPDSIGGLISVEELDCSFNEVEALPSSIGQLTNLRTFAADHNYLQQLPPEIGSWKNITVLFLHSNKLETLPEEMGDMQKLKVINLSDNRLKNLPFSFTKLQQLTAMWLSDNQSKPLIPLQKETDSETQKMVLTNYMFPQQPRTEDVMFISDNESFNPSLWEEQRKQRAQVAFECDEDKDEREAPPREGNLKRYPTPYPDELKNMVKTVQTIVHRLKDEETNEDSGRDLKPHEDQQDINKDVGVKTSESTTTVKSKVDEREKYMIGNSVQKISEPEAEISPGSLPVTANMKASENLKHIVNHDDVFEESEELSSDEEMKMAEMRPPLIETSINQPKVVALSNNKKDDTKETDSLSDEVTHNSNQNNSNCSSPSRMSDSVSLNTDSSQDTSLCSPVKQTHIDINSKIRQEDENFNSLLQNGDILNSSTEEKFKAHDKKDFNLPEYDLNVEERLVLIEKSVDSTATADDTHKLDHINMNLNKLITNDTFQPEIMERSKTQDIVLGTSFLSINSKEETEHLENGNKYPNLESVNKVNGHSEETSQSPNRTEPHDSDCSVDLGISKSTEDLSPQKSGPVGSVVKSHSITNMEIGGLKIYDILSDNGPQQPSTTVKITSAVDGKNIVRSKSATLLYDQPLQVFTGSSSSSDLISGTKAIFKFDSNHNPEEPNIIRGPTSGPQSAPQIYGPPQYNIQYSSSAAVKDTLWHSKQNPQIDHASFPPQLLPRSESTENQSYAKHSANMNFSNHNNVRANTAYHLHQRLGPARHGEMWAISPNDRLIPAVTRSTIQRQSSVSSTASVNLGDPGSTRRAQIPEGDYLSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKIRVRVEKDPELGFSISGGVGGRGNPFRPDDDGIFVTRVQPEGPASKLLQPGDKIIQANGYSFINIEHGQAVSLLKTFQNTVELIIVREVSS

SEQ ID NO: 27925 - protein, 197 aa, Homo sapiens
  ENSP00000425728
  MOD_RES (1)..(1): Any amino acid
XSYREFHSAGRTPPMMPGSQRPLSARTYSIDGPNASRPQSARPSINEIPERTMSVSDFNYSRTSPSKRPNARVGSEHSLLDPPGKSKVPRDWREQVLRHIEAKKLEKSMLSRSFNSNFTTVSSFHCGSSRDLHGSQGSLALSVADRRGSGGHIFRKHPQTSSSGDPCQDGIFISGQQNYSSATLSHKDVPPDSLMKV

SEQ ID NO: 27926 - protein, 158 aa, Homo sapiens
  ENSP00000423959
SMLSRSFNSNFTTVSSFHCGSSRDLHGSQGSLALSVADRRGSGGHIFRKHPQTSSSGDPCQDGIFISGQQNYSSATLSHKDVPPDSLMKMPLSNGQMGQPLRPQANYSQIHHPPQASVARHPSREQLIDYLMLKVAHQPPYTQPHCSPRQGHELAKQE

SEQ ID NO: 27927 - protein, 1302 aa, Homo sapiens; identical to SEQ ID NO: 27924
  ENSP00000370322

SEQ ID NO: 27928 - protein, 957 aa, Homo sapiens
  ENSP00000288221
MYGSARTITNLEGSPSRSPRLPRSPRLGHRRTSSGGGGGTGKTLSMENIQSLNAAYATSGPMYLSDHEGVASTTYPKGTMTLGRATNRAVYGGRVTAMGSSPNIASAGLSHTDVLSYTDQHGGLTGSSHHHHHQVPSMLRQVRDSTMLDLQAQLKELQRENDLLRKELDIKDSKLGSSMNSIKTFWSPELKKERVLRKEEAARMSVLKEQMRVSHEENQHLQLTIQALQDELRTQRDLNHLLQQESGNRGAEHFTIELTEENFRRLQAEHDRQAKELFLLRKTLEEMELRIETQKQTLNARDESIKKLLEMLQSKGLPSKSLEDDNERTRRMAEAESQVSHLEVILDQKEKENIHLREELHRRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKAHNIEDDSRMNPEFADQIKQLDKEASYYRDECGKAQAEVDRLLEILKEVENEKNDKDKKIAELESLTLRHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 27929 - protein, 957 aa, Homo sapiens; identical to SEQ ID NO: 27928
  ENSP00000417445

SEQ ID NO: 27930 - protein, 528 aa, Homo sapiens
  ENSP00000417280
  MOD_RES (1)..(1): Any amino acid
XRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKQAEQLFNQMYNPAHNIEDDSRMNPEFADQIKQLDKEASYYRDECGKAQAEVDRLLEILKEVENEKNDKDKKIAELERHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKK

SEQ ID NO: 27931 - protein, 957 aa, Homo sapiens; identical to SEQ ID NO: 27928
  ENSP00000483127

SEQ ID NO: 27932 - protein, 290 aa, Homo sapiens
  ENSP00000377374
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 27933 - protein, 70 aa, Homo sapiens
  ENSP00000489795
MPFDFRRFDIYRKVPKDLTQPTYTGAIISICCCLFILFLFLSELTGFITTEVPTLGEESVQASWQWLTQS

SEQ ID NO: 27934 - protein, 55 aa, Homo sapiens
  ENSP00000428064
MPFDFRRFDIYRKVPKDLTQPTYTGAIISICCCLFILFLFLSELTGFITTEVGWA

SEQ ID NO: 27935 - protein, 138 aa, Homo sapiens
  ENSP00000427713
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKEVDQQPDVRVCVF

SEQ ID NO: 27936 - protein, 105 aa, Homo sapiens
  ENSP00000429501
MERWAMRVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVI

SEQ ID NO: 27937 - protein, 159 aa, Homo sapiens
  ENSP00000325127
MERWAMRVNELYVDDPDKDSGGKIDVSLNISLPNLHCELVGLDIQDEMGRHEVGHIDNSMKIPLNNGAGCRFEGQFSINKVWKPCLSPFYLLPFPAVSPLPGNWLWRHSLDLTLTQPPASEGSCPAAWPFLLRIWMGVQAPWGFKPLMAGSGRSYSSLQ

SEQ ID NO: 27938 - protein, 54 aa, Homo sapiens
  ENSP00000428116
  MOD_RES (1)..(1): Any amino acid
XVNELYVDDPDKDSGGKIDVSLNISLPNLHCEFFGPQTMSSWRSPARPAPAMDE

SEQ ID NO: 27939 - protein, 374 aa, Homo sapiens
  ENSP00000315614
MGCSSSALNKAGDSSRFPSVTSNEHFSTAEESESCFAQPKPHALGRESTVDGNVQRESRPPLQKLKVSAEPTANGVKPLQEQPLAKDVAPGRDATDQSGSTEKTQPGEGLEESGPPQPGGKEDAPAAEGKKKDAGAGTEAESLKGNAEAQPLGPEAKGQPLQAAVEKDSLRAVEVTENPQTAAEMKPLGTTENVLTLQIAGELQPQGTVGKDEQAPLLETISKENESPEILEGSQFVETAEEQQLQATLGKEEQPQLLERIPKENVTPEVLDRSQLVEKPVMNDPFHKTPEGPGNMEQIQPEGIVGSMEHPARNVEAGAYVEMIRNIHTNEEDQRIEGETGEKVETDMENEKVSEGAETKEEETGEVVDLSAAT

SEQ ID NO: 27940 - protein, 56 aa, Homo sapiens
  ENSP00000440297
MGCSSSALNKAGDSSRFPSGETGEKVETDMENEKVSEGAETKEEETGEVVDLSAAT

SEQ ID NO: 27941 - protein, 284 aa, Homo sapiens
  ENSP00000387047
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 27942 - protein, 297 aa, Homo sapiens
  ENSP00000380453
MKTLSPDRIQPHIMTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 27943 - protein, 84 aa, Homo sapiens
  ENSP00000387339
MTDVPATFTQAECNGDKPPENGQQTITKISEELTDVDSPLPHYRVEPSLEGALTKGSQEERRKLQGNMLLNSSMEDKMLKGWSI

SEQ ID NO: 27944 - protein, 264 aa, Homo sapiens
  ENSP00000410646
MTDVPATFTQAECNGDKPPENGQQTITKISEELTDVDSPLPHYRVEPSLEGALTKGSQEERRKLQGNMLLNSSMEDKMLKETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 27945 - protein, 160 aa, Homo sapiens
  ENSP00000398149
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWL

SEQ ID NO: 27946 - protein, 152 aa, Homo sapiens
  ENSP00000389595
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGH

SEQ ID NO: 27947 - protein, 146 aa, Homo sapiens
  ENSP00000387049
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREDGVSLLLPRLECNGAISADCNLCLQGSSDSPASAS

SEQ ID NO: 27948 - protein, 146 aa, Homo sapiens; identical to SEQ ID NO: 27947
  ENSP00000387325

SEQ ID NO: 27949 - protein, 111 aa, Homo sapiens
  ENSP00000410934
MTDVPATFTQAECNGDKPPENGQQTITKISEELTDVDSPLPHYRVEPSLEGALTKGSQEERRKLQGNMLLNSSMEDKMLKEEKLFIVHKAITDLSLQETSADEMTFREGHQ

SEQ ID NO: 27950 - protein, 508 aa, Homo sapiens
  ENSP00000424992
MLLNRMSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKH

SEQ ID NO: 27951 - protein, 500 aa, Homo sapiens
  ENSP00000423004
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKAWARADSLQEWRPLEQVPSPLHRATKRQHVHFLTPLPPPPSVAWVGTAQAGYHLEVFLPQRAGWPRAA

SEQ ID NO: 27952 - protein, 508 aa, Homo sapiens
  ENSP00000370270
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKHLWLTM

SEQ ID NO: 27953 - protein, 433 aa, Homo sapiens
  ENSP00000451658
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKV

SEQ ID NO: 27954 - protein, 508 aa, Homo sapiens; identical to SEQ ID NO: 27952
  ENSP00000422488

SEQ ID NO: 27955 - protein, 53 aa, Homo sapiens
  ENSP00000466958
MSIAGVAAQEIRVPLKTGFLHNGRAMGNMRKTYWSSRSEFKNTGRKLPGTVGD

SEQ ID NO: 27956 - protein, 462 aa, Homo sapiens
  ENSP00000366702
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 27957 - protein, 79 aa, Homo sapiens
  ENSP00000465100
MSIAGVAAQEIRVPLKTGFLHNGRAMGNMRKTYWSSRSEFKNNFLNIDPITMAYSLNSSAQERLIPLGMYSENLITVSI

SEQ ID NO: 27958 - protein, 74 aa, Homo sapiens
  ENSP00000466454
MSIAGVAAQEIRVPLKTGFLHNGRAMGNMRKTYWSSRSEFKKACFQICSDEWPLLCRKWSISKVQLAPSSYSPK

SEQ ID NO: 27959 - protein, 52 aa, Homo sapiens
  ENSP00000467030
MSIAGVAAQEIRVPLKTGFLHNGRAMGNMRKTYWSSRSEFKNFLSFQQLFKY

SEQ ID NO: 27960 - protein, 435 aa, Homo sapiens
  ENSP00000355907
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 27961 - protein, 470 aa, Homo sapiens
  ENSP00000355904
MWRECDWGLGAVKSDLACVPSAKRLLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPLLWSDPADNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 27962 - protein, 458 aa, Homo sapiens
  ENSP00000386171
MDSVELCLPESFSLHYEEELLCRMSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 27963 - protein, 435 aa, Homo sapiens; identical to SEQ ID NO: 27960
  ENSP00000353108

SEQ ID NO: 27964 - protein, 435 aa, Homo sapiens; identical to SEQ ID NO: 27960
  ENSP00000354584

SEQ ID NO: 27965 - protein, 435 aa, Homo sapiens; identical to SEQ ID NO: 27960
  ENSP00000355905

SEQ ID NO: 27966 - protein, 435 aa, Homo sapiens; identical to SEQ ID NO: 27960
  ENSP00000352077

SEQ ID NO: 27967 - protein, 435 aa, Homo sapiens; identical to SEQ ID NO: 27960
  ENSP00000419594

SEQ ID NO: 27968 - protein, 396 aa, Homo sapiens
  ENSP00000418629
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANSDSMHIEDVEAVQKLQDVLHEALQDYEAGQHMEDPRRAGKMLMTLPLLRQTSTKAVQHFYNIKLEGKVPMHKLFLEMLEAKV

SEQ ID NO: 27969 - protein, 435 aa, Homo sapiens; identical to SEQ ID NO: 27960
  ENSP00000419155

SEQ ID NO: 27970 - protein, 435 aa, Homo sapiens; identical to SEQ ID NO: 27960
  ENSP00000417374

SEQ ID NO: 27971 - protein, 354 aa, Homo sapiens
  ENSP00000419514
MSNKDRHIDSSCSSFIKTEPSSPASLTDSVNHHSPGGSSDASGSYSSTMNGHQNGLDSPPLYPSAPILGGSGPVRKLYDDCSSTIVEDPQTKCEYMLNSMPKRLCLVCGDIASGYHYGVASCEACKAFFKRTIQGNIEYSCPATNECEITKRRRKSCQACRFMKCLKVGMLKEGVRLDRVRGGRQKYKRRIDAENSPYLNPQLVQPAKKPYNKIVSHLLVAEPEKIYAMPDPTVPDSDIKALTTLCDLADRELVVIIGWAKHIPGFSTLSLADQMSLLQSAWMEILILGVVYRSLSFEDELVYADDYIMDEDQSKLAGLLDLNNAILQLVKKYKSMKLEKEEFVTLKAIALANS

SEQ ID NO: 27972 - protein, 47 aa, Homo sapiens
  ENSP00000466343
MWRECDWGLGAVKSDLACVPSAKRREPLAREETGLLMNANRRSSICA

SEQ ID NO: 27973 - protein, 92 aa, Homo sapiens
  ENSP00000417900
MSNKDRHIDSSCSSFIKTEPSSPASLTDSVNHHSPGGSSDASGSYSSTMNGHQNGLDSPPLYPSAPILGGSGPVRKLYDDCSSTIVEDPQTK

SEQ ID NO: 27974 - protein, 55 aa, Homo sapiens
  ENSP00000420370
MSNKDRHIDSSCSSFIKTEPSSPASLTDSVNHHSPGGSSDASGSYSSTMNGHQNG

SEQ ID NO: 27975 - protein, 50 aa, Homo sapiens
  ENSP00000418895
MSNKDRHIDSSCSSFIKTEPSSPASLTDSVNHHSPGGSSDASGSYSSTMN

SEQ ID NO: 27976 - protein, 435 aa, Homo sapiens; identical to SEQ ID NO: 27960
  ENSP00000481528

SEQ ID NO: 27977 - protein, 435 aa, Homo sapiens; identical to SEQ ID NO: 27960
  ENSP00000375761

SEQ ID NO: 27978 - protein, 435 aa, Homo sapiens; identical to SEQ ID NO: 27960
  ENSP00000355225

SEQ ID NO: 27979 - protein, 893 aa, Homo sapiens
  ENSP00000251527
MTPPSRAEAGVRRSRVPSEGRWRGAEPPGISASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 27980 - protein, 884 aa, Homo sapiens
  ENSP00000275418
SASTQPASAGRAARHCGAMSGARGEGPEAGAGGAGGRAAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSNPLEFNPDVLKKTAVQRALKSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 27981 - protein, 921 aa, Homo sapiens
  ENSP00000481296
MTANRDAALSSHRHPGCAQRPRTPTFASSSQRRSAFGFDDGNFPGLGERSHAPGSRLGARRRAKTARGLRGHRQRGAGAGLSRPGSARAPSPPRPGAPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 27982 - protein, 404 aa, Homo sapiens
  ENSP00000421288
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 27983 - protein, 437 aa, Homo sapiens
  ENSP00000353741
MADDPSAADRNVEIWKIKKLIKSLEAARGNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 27984 - protein, 423 aa, Homo sapiens
  ENSP00000422203
MKQDVLNCTEGPIHSNGTSMISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDMFDQRLQSKVLKLVDISYGGENGFNQAIELSTEVLSNVKFIQEKKLIGRYFDEISQDTGKYCFGVEDTLKALEMGAVEILIVYENLDIMRYVLHCQGTEEEKILYLTPEQEKDKSHFTDKETGQEHELIESMPLLEWFANNYKKFGATLEIVTDKSQEGSQFVKGFGGIGGILRYRVDFQGMEYQGGDDEFFDLDDY

SEQ ID NO: 27985 - protein, 95 aa, Homo sapiens
  ENSP00000422272
MADDPSAADRNVEIWKIKKLIKSLEAARGNGTSMISLIIPPKDQISRVAKMLADEFGTASNIKSRVNRLSVLGAITSVQQRLKLYNKGSYSTTFR

SEQ ID NO: 27986 - protein, 208 aa, Homo sapiens
  ENSP00000461082
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVIDGSGALFGTLQGNTREVLHKFTVDLPKKHGRGGQSALRFARLRMEKRHNYVRKVAETAVQLFISGDKVNVAGLVLAGSADFKTELSQSDM

SEQ ID NO: 27987 - protein, 119 aa, Homo sapiens
  ENSP00000425689
MISLIIPPKDQISRVAKMLADEFGTASNIKSRVNRLSVLGAITSVQQRLKLYNKVPPNGLVVYCGTIVTEEGKEKKVNIDFEPFKPINTSLYLCDNKFHTEALTALLSDDSKFGFIVID

SEQ ID NO: 27988 - protein, 1264 aa, Homo sapiens
  ENSP00000365645
MQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 27989 - protein, 165 aa, Homo sapiens
  ENSP00000489926
MSKPSRLARPFFSNAASKLPSARRDDLNSKQKKNSLGEKILRTGSEGNLVKQQQVQTAATPAQRKATPHKEQGKGNLHVTSPEDAECRRTKERLSNGNSRGSVSKSSRNIPRRHTLGGPRSSKEILGMQTSEMDRKREAFLEHLKQKYPHHASAIMGHQERLRDQ

SEQ ID NO: 27990 - protein, 933 aa, Homo sapiens
  ENSP00000365639
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKA

SEQ ID NO: 27991 - protein, 1943 aa, Homo sapiens
  ENSP00000365637
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETRERMQAMEKQIASLTGLVQSALFKGPITSYSKDASSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 27992 - protein, 180 aa, Homo sapiens
  ENSP00000489052
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQALKGMLISLQAELDIQRQGAPNCLTVLNHPVWVTRSSIYQRRPLILWKPCLRGMLQPLFPEA

SEQ ID NO: 27993 - protein, 783 aa, Homo sapiens
  ENSP00000404798
MSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKA

SEQ ID NO: 27994 - protein, 932 aa, Homo sapiens
  ENSP00000302343
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKGSSGAPQTSRMPVPMSAKNRPGTLDKPGKQSKLQDPRQYRQVVLP

SEQ ID NO: 27995 - protein, 866 aa, Homo sapiens
  ENSP00000379723
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQGSSGAPQTSRMPVPMSAKNRPGTLDKPGKQSKLQDPRQYRQVVLP

SEQ ID NO: 27996 - protein, 906 aa, Homo sapiens
  ENSP00000379722
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKGSSGAPQTSRMPVPMSAKNRPGTLDKPGKQSKLQDPRQYRQVVLP

SEQ ID NO: 27997 - protein, 1465 aa, Homo sapiens
  ENSP00000365634
MQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQVVLP

SEQ ID NO: 27998 - protein, 453 aa, Homo sapiens
  ENSP00000489575
  MOD_RES (1)..(1): Any amino acid
XDKIMAELQAFQKCSFMDVNSNSHAEPSRADSHVKDTRSGATVPPKEKKGIFGSWRTKQSKNLEFFHEDVRKSDVEYENGPQMEFQKVTTGAVRPSDPPKWERGMENSISDASRTSEYKTEIIMKENSISNMSLLRDSRNYSQETVPKASFGFSGISPLEDEINKGSKISGLQYSIPDTENQTLNYGKTKEMEKQNTDKCHVSSHTRLTESSVHDFKTEDQEVITTDFGQVVLRPKEARHANVNPNEDGESSSSSPTEENAATDNIAFMITETTVQVLSSGEVHDIVSQKGEDIQTVNIDARKEMTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPK

SEQ ID NO: 27999 - protein, 1349 aa, Homo sapiens
  ENSP00000392625
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSEDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 28000 - protein, 1374 aa, Homo sapiens
  ENSP00000365635
MEENESQKCEPCLPYSADRRQMQEQGKGNLHVTSPEDAECRRTKERLSNGNSRGSVSKSSRNIPRRHTLGGPRSSKEILGMQTSEMDRKREAFLEHLKQKYPHHASAIMGHQERLRDQTRSPKLSHSPQPPSLGDPVEHLSETSADSLEAMSEGDAPTPFSRGSRTRASLPVVRSTNQTKERSLGVLYLQYGDETKQLRMPNEITSADTIRALFVSAFPQQLTMKMLESPSVAIYIKDESRNVYYELNDVRNIQDRSLLKVYNKDPAHAFNHTPKTMNGDMRMQRELVYARGDGPGAPRPGSTAHPPHAIPNSPPSTPVPHSMPPSPSRIPYGGTRSMVVPGNATIPRDRISSLPVSRPISPSPSAILERRDVKPDEDMSGKNIAMYRNEGFYADPYLYHEGRMSIASSHGGHPLDVPDHIIAYHRTAIRSASAYCNPSMQAEMHMEQSLYRQKSRKYPDSHLPTLGSKTPPASPHRVSDLRMIDMHAHYNAHGPPHTMQPDRASPSRQAFKKEPGTLVYIEKPRSAAGLSSLVDLGPPLMEKQVFAYSTATIPKDRETSEKMMKTTANRNHTDSAGTPHVSGGKMLSALESTVPPSQPPPVGTSAIHMSLLEMRRSVAELRLQLQQMRQLQLQNQELLRAMMKKAELEISGKVMETMKRLEDPVQRQRVLVEQERQKYLHEEEKIVKKLCELEDFVEDLKKDSTAASRLVTLKDVEDGAFLLRQVGEAVATLKGEFPTLQNKMRAILRIEVEAVRFLKEEPHKLDSLLKRVRSMTDVLTMLRRHVTDGLLKGTDAAQAAQYMAMEKATAAEVLKSQEEAAHTSGQPFHSTGAPGDAKSEVVPLSGMMVRHAQSSPVVIQPSQHSVALLNPAQNLPHVASSPAVPQEATSTLQMSQAPQSPQIPMNGSAMQSLFIEEIHSVSAKNRAVSIEKAEKKWEEKRQNLDHYNGKEFEKLLEEAQANIMKSIPNLEMPPATGPLPRGDAPVDKVELSDSPNSEQDLEKLGGKSPPPPPPPPRRSYLPGSGLTTTRSGDVVYTGRKENITAKASSEDAGPSPQTRATKYPAEEPASAWTPSPPPVTTSSSKDEEEEEEEGDKIMAELQAFQKCSFMDVNSNSHAEPSRADSHVKDTRSGATVPPKEKKNLEFFHEDVRKSDVEYENGPQMEFQKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 28001 - protein, 1264 aa, Homo sapiens; identical to SEQ ID NO: 27988
  ENSP00000389680

SEQ ID NO: 28002 - protein, 499 aa, Homo sapiens
  ENSP00000296486
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28003 - protein, 493 aa, Homo sapiens
  ENSP00000392269
MCELYSKRDTLGLRKKHIGPSCKVFFASDPIKIVRAQRQYMFDENGEQYLDCINNVAHGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28004 - protein, 441 aa, Homo sapiens
  ENSP00000427065
MGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28005 - protein, 459 aa, Homo sapiens
  ENSP00000423240
MFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 28006 - protein, 64 aa, Homo sapiens
  ENSP00000422050
MCELYSKRDTLGLRKKHIGPSCKVFFASDPIKIVRAQRQYMFDENGEQYLDCINNVAHDPKPTT

SEQ ID NO: 28007 - protein, 49 aa, Homo sapiens
  ENSP00000426871
MCELYSKRDTLGLRKKHIGGTLSPRSGQSCPETDGTAKYKFSIPPRQHC

SEQ ID NO: 28008 - protein, 60 aa, Homo sapiens
  ENSP00000421217
MELLNTNSRFLHDNIVEYAKRLSATLPEKLSVCYFTNSGSEANDLALRLARQFRGHQDVI

SEQ ID NO: 28009 - protein, 70 aa, Homo sapiens
  ENSP00000426525
MGHCHPGVVKAALKQMELLNTNSRFLHDNIVEYAKRLSATLPEKLSVCYFTNSGSEANDLALRLARQFRG

SEQ ID NO: 28010 - protein, 485 aa, Homo sapiens
  ENSP00000376436
MSYFVDSAGSSPVPYSAPRPAVVRQGPSNTYEDPRMNCGFQSNYHQQRPCYPFWDEMATQEVPTGLEHCVSDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 28011 - protein, 354 aa, Homo sapiens
  ENSP00000433500
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 28012 - protein, 272 aa, Homo sapiens
  ENSP00000435666
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCGQEMGKEEKQT

SEQ ID NO: 28013 - protein, 441 aa, Homo sapiens
  ENSP00000324578
MKAAVDLKPTLTIIKTEKVDLELFPSPDMECADVPLLTPSSKEMMSQALKATFSGFTKEQQRLGIPKDPRQWTETHVRDWVMWAVNEFSLKGVDFQKFCMNGAALCALGKDCFLELAPDFVGDILWEHLEILQKEDVKPYQVNGVNPAYPESRYTSDYFISYGIEHAQCVPPSEFSEPSFITESYQTLHPISSEELLSLKYENDYPSVILRDPLQTDTLQNDYFAIKQEVVTPDNMCMGRTSRGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 28014 - protein, 46 aa, Homo sapiens
  ENSP00000476649
MECADVPLLTPSSKEMMSQALKATFSGFTKEQQRLGIPKDPRQWTE

SEQ ID NO: 28015 - protein, 225 aa, Homo sapiens
  ENSP00000441430
MKAAVDLKPTLTIIKTEKVDLELFPSPGKLGGQDSFESIESYDSCDRLTQSWSSQSSFNSLQRVPSYDSFDSEDYPAALPNHKPKGTFKDYVRDRADLNKDKPVIPAAALAGYTGSGPIQLWQFLLELLTDKSCQSFISWTGDGWEFKLSDPDEVARRWGKRKNKPKMNYEKLSRGLRYYYDKNIIHKTAGKRYVYRFVCDLQSLLGYTPEELHAMLDVKPDADE

SEQ ID NO: 28016 - protein, 477 aa, Homo sapiens
  ENSP00000405327
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28017 - protein, 454 aa, Homo sapiens
  ENSP00000385381
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28018 - protein, 491 aa, Homo sapiens
  ENSP00000384085
MSGRGDGGQQQLLHSKFLAGFVCHIEKNESQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28019 - protein, 437 aa, Homo sapiens
  ENSP00000384138
MLQDLSASVFFPPCSQHRTLAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28020 - protein, 477 aa, Homo sapiens; identical to SEQ ID NO: 28016
  ENSP00000385551

SEQ ID NO: 28021 - protein, 367 aa, Homo sapiens
  ENSP00000413836
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGFSNVALSVIILRGICLSTDHRRHQTRARNVSGRTHIPTARITSALAVFGSSSG

SEQ ID NO: 28022 - protein, 459 aa, Homo sapiens
  ENSP00000385686
MDGFYDQQVPYMVTNSQRGRNCNEKPTNVRKRKFINRDLAHDSEELFQDLSQLQETWLAEVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28023 - protein, 288 aa, Homo sapiens
  ENSP00000393078
MLQDLSASVFFPPCSQHRTLVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLD

SEQ ID NO: 28024 - protein, 173 aa, Homo sapiens
  ENSP00000394710
MLQDLSASVFFPPCSQHRTLAQVPDNDEQFVPDYQAESLAFHGLPLKIKKEPHSPCSEISSACSQEQPFKFSYGEKCLYNVRFRRQLSEPCNSFPPLPTMPREGRPMYQRQMSEPNIPFPPQGFKQEYHDPVYEHNTMVGSAASQSFPPPLMIKQEPRDFAYDSEVPSCHSIY

SEQ ID NO: 28025 - protein, 123 aa, Homo sapiens
  ENSP00000391043
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSPCSEISSACSQEQPFKFSYGEKCLYNVSA

SEQ ID NO: 28026 - protein, 95 aa, Homo sapiens
  ENSP00000410819
MDGFYDQQVPYMVTNSQRGRNCNEKPTNVRKRKFINRDLAHDSEELFQDLSQLQETWLAEAQVPDNDEQFVPDYQAESLAFHGLPLKIKKEPHSP

SEQ ID NO: 28027 - protein, 20 aa, Homo sapiens
  ENSP00000406931
MDGFYDQQVPYMVTNSQRGR

SEQ ID NO: 28028 - protein, 419 aa, Homo sapiens
  ENSP00000411626
MLQDLSASVFFPPCSQHRTLVAFHGLPLKIKKEPHSPCSEISSACSQEQPFKFSYGEKCLYNVSAYDQKPQVGMRPSNPPTPSSTPVSPLHHASPNSTHTPKPDRAFPAHLPPSQSIPDSSYPMDHRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28029 - protein, 459 aa, Homo sapiens; identical to SEQ ID NO: 28022
  ENSP00000242066

SEQ ID NO: 28030 - protein, 374 aa, Homo sapiens
  ENSP00000382293
MLQDLSASVFFPPCSQHRTLAQVPDNDEQFVPDYQAESLAFHGLPLKIKKEPHSPCSEISSACSQEQPFKFSYGEKCLYNVRFRRQLSEPCNSFPPLPTMPREGRPMYQRQMSEPNIPFPPQGFKQEYHDPVYEHNTMVGSAASQSFPPPLMIKQEPRDFAYDSEVPSCHSIYMRQEGFLAHPSRTEGCMFEKGPRQFYDDTCVVPEKFDGDIKQEPGMYREGPTYQRRGSLQLWQFLVALLDDPSNSHFIAWTGRGMEFKLIEPEEVARRWGIQKNRPAMNYDKLSRSLRYYYEKGIMQKVAGERYVYKFVCDPEALFSMAFPDNQRPLLKTDMERHINEEDTVPLSHFDESMAYMPEGGCCNPHPYNEGYVY

SEQ ID NO: 28031 - protein, 143 aa, Homo sapiens
  ENSP00000327316
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGKIQTLLVGN

SEQ ID NO: 28032 - protein, 512 aa, Homo sapiens
  ENSP00000357175
MKAGCSIVEKPEGGGGYQFPDWAYKTESSPGSRQIQLWHFILELLQKEEFRHVIAWQQGEYGEFVIKDPDEVARLWGRRKCKPQMNYDKLSRALRYYYNKRILHKTKGKRFTYKFNFNKLVMPNYPFINIRSSGVVPQSAPPVPTASSRFHFPPLDTHSPTNDVQPGRFSASSLTASGQESSNGTDRKTELSELEDGSAADWRRGVDPVSSRNAIGGGGIGHQKRKPDIMLPLFARPGMYPDPHSPFAVSPIPGRGGVLNVPISPALSLTPTIFSYSPSPGLSPFTSSSCFSFNPEEMKHYLHSQACSVFNYHLSPRTFPRYPGLMVPPLQCQMHPEESTQFSIKLQPPPVGRKNRERVESSEESAPVTTPTMASIPPRIKVEPASEKDPESLRQSAREKEEHTQEEGTVPSRTIEEEKGTIFARPAAPPIWPSVPISTPSGEPLEVTEDSEDRPGKEPSAPEKKEDALMPPKLRLKRRWNDDPEARELSKSGKFLWNGSGPQGLATAAADA

SEQ ID NO: 28033 - protein, 484 aa, Homo sapiens
  ENSP00000321835
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28034 - protein, 484 aa, Homo sapiens; identical to SEQ ID NO: 28033
  ENSP00000377273

SEQ ID NO: 28035 - protein, 445 aa, Homo sapiens
  ENSP00000440023
MDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28036 - protein, 430 aa, Homo sapiens
  ENSP00000441749
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28037 - protein, 484 aa, Homo sapiens; identical to SEQ ID NO: 28033
  ENSP00000465718

SEQ ID NO: 28038 - protein, 207 aa, Homo sapiens
  ENSP00000468636
MYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 28039 - protein, 28 aa, Homo sapiens
  ENSP00000466673
MDPGSLPPLDSEDLFQDLSHFQETWLAE

SEQ ID NO: 28040 - protein, 445 aa, Homo sapiens; identical to SEQ ID NO: 28035
  ENSP00000443846

SEQ ID NO: 28041 - protein, 510 aa, Homo sapiens
  ENSP00000306894
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 28042 - protein, 510 aa, Homo sapiens; identical to SEQ ID NO: 28041
  ENSP00000413755

SEQ ID NO: 28043 - protein, 89 aa, Homo sapiens
  ENSP00000399707
  MOD_RES (1)..(1): Any amino acid
XVPAAPPPPQGFKQEYHDPLYEHGVPGMPGPPAHGFQSPMGIKQEPRDYCVDSEVPNCQSSYMRGGYFSSSHEGCSALGHPEEPASHEL

SEQ ID NO: 28044 - protein, 150 aa, Homo sapiens
  ENSP00000389707
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLF

SEQ ID NO: 28045 - protein, 140 aa, Homo sapiens
  ENSP00000412171
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTP

SEQ ID NO: 28046 - protein, 132 aa, Homo sapiens
  ENSP00000405157
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFK

SEQ ID NO: 28047 - protein, 132 aa, Homo sapiens
  ENSP00000388737
MDGFYDQQVPFMVPGKSRSEECRGRPVIDRKRKFLDTDLAHDSEELFQDLSQLQEAWLAEAQVPDDEQFVPDFQSDNPFLFKLPQEFMIPFQFQFVAILYSPGSLSSFSKSAVQSGASCPTSNQDQTGAAQP

SEQ ID NO: 28048 - protein, 152 aa, Homo sapiens
  ENSP00000377490
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 28049 - protein, 152 aa, Homo sapiens; identical to SEQ ID NO: 28048
  ENSP00000386435

SEQ ID NO: 28050 - protein, 140 aa, Homo sapiens
  ENSP00000386835
MKGSKSFVLQKMFSCSKNPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 28051 - protein, 152 aa, Homo sapiens; identical to SEQ ID NO: 28048
  ENSP00000386930

SEQ ID NO: 28052 - protein, 142 aa, Homo sapiens
  ENSP00000398249
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEV

SEQ ID NO: 28053 - protein, 101 aa, Homo sapiens
  ENSP00000388105
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHR

SEQ ID NO: 28054 - protein, 152 aa, Homo sapiens; identical to SEQ ID NO: 28048
  ENSP00000233712

SEQ ID NO: 28055 - protein, 245 aa, Homo sapiens
  ENSP00000315476
MAGLELLSDQGYRVDGRRAGELRKIQARMGVFAQADGSAYIEQGNTKALAVVYGPHEIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVREASILLGD

SEQ ID NO: 28056 - protein, 156 aa, Homo sapiens
  ENSP00000432661
MAGLELLSDQGYRVDGRRAGELRKIQARMGVFAQADGSAYIEQGNTKALAVVYGPHEIRGSRARALPDRALVNCQYSSATFSTGATGRWWDLCSLCECSHAGSAGCRDTHERLCVCVLSWLRGRHSPGGPQPCGGSSWWPPAGPGPAASLRTDCAA

SEQ ID NO: 28057 - protein, 261 aa, Homo sapiens
  ENSP00000436539
MFVNLGWQGMGQGWTQGSQLKGARGRHMQDRERKTGGFVLEVTQLPLAEALKVEGEADPQRTVECELEGVGLAHVSVLFQIRGSRARALPDRALVNCQYSSATFSTGERKRRPHGDRKSCEMGLQLRQTFEAAILTQLHPRSQIDIYVQVLQADGGTYAACVNAATLAVLDAGIPMRDFVCACSAGFVDGTALADLSHVEEAAGGPQLALALLPASGQIALLEMDARLHEDHLERVLEAAAQAARDVHTLLDRVVRQHVRE

SEQ ID NO: 28058 - protein, 1989 aa, Homo sapiens
  ENSP00000265843
MTKVPPAFDFSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSDCDTDTTTDDEYYLDENDKESEL

SEQ ID NO: 28059 - protein, 1982 aa, Homo sapiens
  ENSP00000432546
MSLSFLNDEEARKILQVLERNEELQRAEKDRISKLQKTKRDIRWLQGVTGEWFEEIQRKKFCNETDVSQMLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRKSHPPKVRERHFSESTSIDNALSRLTLGNEFSVNNGYSRRFRSFSELPSCDGNESWAYRSGTKTGPRSAISIYRPIDYGIFGKEQQLAFLENVKRSLTQGRLWKPSFLKNPGFLKDDLRNPPNPSESLSSNSPSSQVPEDGLSPSEPLNIYEDDPVDSDCDTDTTTDDEYYLDENDKESEL

SEQ ID NO: 28060 - protein, 1733 aa, Homo sapiens
  ENSP00000432683
MLKQPLTYRLSKEMAKNDPIELPTSRSKNVTNQKKPTPFSSRMSFRSSFASLFSFRKSGKETSKLPSLGQKGCDGHAGPPMPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSENKKERGKKLQSETLHTSLMLQRKNVSEEKSENCQQSINSSNSGPSSLPALSEVNIGNSQTRRSSWECTGSGRAIPFTGSGKCPQKDHTSTAVGDGSSGSQPREGRGDIGTNCQKMTNKTLSHSESQVFALTPALHKLQLGEETQSDEPNLESLQSEPRELPQRSQEANMTESRKAEDEMQKSAWDQPSLPEGNKNKTNLDDLVKGENRSSVKHRLAAMSKASRKFPAKDVSPRRHVATIFPQSGSRSGFDHLSLGTVECNPLFPEPTPKSAESIGESRLSENGKHVKKSENLLPITVLPNREPSTHVSNQKSNSISQRHQNEFKNVSESPSKHENSKDVTAAQNLVRESGAPSPITFTSLREAEFSDNQRRLSPPFPLEPAQKSRVSSPLASFLQQQRSASSLEWEPEPHLYRSKSLKSINVHGDLLRK

SEQ ID NO: 28061 - protein, 1192 aa, Homo sapiens
  ENSP00000446434
MREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNEKDLNESISEEDKQLSKMDQTNKAGEIPQPVSQTGISNSLPDFQNPLSQDSAKSNGFGFNASTIISSKKSPRVFSRKDTSKMYIPHTDKSNDIKQDKRFTENRKLGSTASLPFIQEHRTPPSFPRTDQGCHQELTVNNEDISRIITNNHWSSALTDTQNAQYSKCKLTPGHKTSCDSLDLSSAALPDSSPSKNSSLDAPVVPSTTVFSRRSPSDKDPSLGEREEKDNAGKNQKNQFIVSHSENQERNDSPVPTHDEVVDVKCHSHSPFRNERGKGKIRHHISCIEKLSKTESISVPTSDHRSLIEANQSNSKVSELDTIYCTLPRKSSSFLIHGRQSGSKIMAASLRNGPPPFQIKNNVEDAMGNYMLNKFSPSSPESANECSKVLSDSALEAPEATERMTNVKSSGSTSVRKGPLPFLINRAMSCPSGEPHASTGREGRKKPLTSGMDASELTPRAWERIISPVESDSSVRDCSLTKRQHQKENFQEYTEKEGKMAASRRSVFALSNEDPLPFCSDLSGKERGKTLHKVKTTSTFSVSGDEDNVKCLEVVSIYYTLPRKPSKKFCNLLQQYTQNTNLLIESPQVETETFPNALEKDKQNYSTREQSGTPSCENLKMSVNSDQTLTTENMTAFRLSNRGPLAPTLQEMASVEAAVSLPEEESKAREIFSDNLAKTPLGDSE

SEQ ID NO: 28062 - protein, 544 aa, Homo sapiens
  ENSP00000482691
MPVRGAAVQAKIYNSPLENHLVDSTFVPKPAVMREESGMPPPWDASLLENEFFQVLDDLDSKLAQEQSASSVNTRTPLNYGSRTQFGHFYSSGNRHGNITERHKKHYNETSNMSIYDILRPGTPREGFKTFSPRTSTIYDMYRTREPRVFKEDYVQKNTFGSTSLCFDSRQRSALPATGHFTARSLHFPATTQSKSGFIPPRHQQSPKRTPLSSIIWNRSDSSRDRENQEEFLRAPSPMEIDPADKYVYPRGFQENKRYESYHSQNVYQRVSLNAPMENAMSPDTFENSENMPFYHQSNTFTRSFFSNTFGRSGEQRRFGQGPFWGQEKGHSFWSDFHRSRKSFSSSDRDFEMISMEANSVSAIHGHNVSSEHWESFSSGYGTDVSRGQEEPHPWQFDFQRSTLDSMVVSHGNETQLTPHFGTPNVCSMTGSSYHVKSSELVSQQDSSPVEVHINKEASSFGIAQTLASSFKTSFSQISDDRRNPQSPNLQNPTVTLQKIFPNKPASHPMRSHTEVTVTSSNSVDSLPLAKSQPNILVTEVNNE

SEQ ID NO: 28063 - protein, 79 aa, Homo sapiens
  ENSP00000433909
MLKQPLTYRLSKEMAKNDPIELPTSRSKNVTNQKKPTPFSSRMSFRSSFASLFSFRKSGKETSKLPSLGQKGCDGHAGP

SEQ ID NO: 28064 - protein, 330 aa, Homo sapiens
  ENSP00000359131
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 28065 - protein, 330 aa, Homo sapiens; identical to SEQ ID NO: 28064
  ENSP00000359132

SEQ ID NO: 28066 - protein, 266 aa, Homo sapiens
  ENSP00000403363
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGK

SEQ ID NO: 28067 - protein, 117 aa, Homo sapiens
  ENSP00000392255
MGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANR

SEQ ID NO: 28068 - protein, 147 aa, Homo sapiens
  ENSP00000444385
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAIS

SEQ ID NO: 28069 - protein, 592 aa, Homo sapiens
  ENSP00000373394
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28070 - protein, 212 aa, Homo sapiens
  ENSP00000428391
MEMQDLTSPHSRLSGSSESPSGPKLGNSHINSNSMTPNGTEVKTEPMSSSETASTTADGSLNNFSGSAIGSSSFSPRPTHQFSPPQIYPSNLPQECNKLQPMPRTHSQDSRTAFPHMASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 28071 - protein, 592 aa, Homo sapiens; identical to SEQ ID NO: 28069
  ENSP00000342626

SEQ ID NO: 28072 - protein, 586 aa, Homo sapiens
  ENSP00000303221
MEMQDLTSPHSRLSGSSESPSGPKLGNSHINSNSMTPNGTEVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28073 - protein, 558 aa, Homo sapiens
  ENSP00000373393
MLLFPQVAVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28074 - protein, 591 aa, Homo sapiens
  ENSP00000373395
MEMQDLTSPHSRLSGSSESPSGPKLGNSHINSNSMTPNGTEVKTEPMSSSETASTTADGSLNNFSGSAIGSSSFSPRPTHQFSPPQIYPSKPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28075 - protein, 557 aa, Homo sapiens
  ENSP00000410176
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28076 - protein, 41 aa, Homo sapiens
  ENSP00000428517
MEEMIFNLADTHLFFNDLEESRASRESMMLVKLGRRKPSSA

SEQ ID NO: 28077 - protein, 559 aa, Homo sapiens
  ENSP00000373392
MLLFPQVAVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 28078 - protein, 3144 aa, Homo sapiens
  ENSP00000424243
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 28079 - protein, 3165 aa, Homo sapiens
  ENSP00000359655
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRCSCSLSYIGRLCVVNVDYCLGNHSISVHGLCLALSHNCNCSGLQRYERNICEIDTEDCKSASCKNGTTSTHLRGYFFRKCVPGFKGTQCEIDIDECASHPCKNGATCIDQPGNYFCQCVPPFKVVDGFSCLCNPGYVGIRCEQDIDDCILNACEHNSTCKDLHLSYQCVCLSDWEGNFCEQESNECKMNPCKNNSTCTDLYKSYRCECTSGWTGQNCSEEINECDSDPCMNGGLCHESTIPGQFVCLCPPLYTGQFCHQRYNLCDLLHNPCRNNSTCLALVDANQHCICREEFEGKNCEIDVKDCLFLSCQDYGDCEDMVNNFRCICRPGFSGSLCEIEINECSSEPCKNNGTCVDLTNRFFCNCEPEYHGPFCELDVNKCKISPCLDEENCVYRTDGYNCLCAPGYTGINCEINLDECLSEPCLHDGVCIDGINHYTCDCKSGFFGTHCETNANDCLSNPCLHGRCTELINEYPCSCDADGTSTQCKIKINDCTSIPCMNEGFCQKSAHGFTCICPRGYTGAYCEKSIDNCAEPELNSVICLNGGICVDGPGHTFDCRCLPGFSGQFCEININECSSSPCLHGADCEDHINGYVCKCQPGWSGHHCENELECIPNSCVHELCMENEPGSTCLCTPGFMTCSIGLLCGDEIRRITCLTPIFQRTDPISTQTYTIPPSETLVSSFPSIKATRIPAIMDTYPVDQGPKQTGIVKHDILPTTGLATLRISTPLESYLLQELIVTRELSAKHSLLSSADVSSSRFLNFGIRDPAQIVQDKTSVSHMPIRTSAATLGFFFPDRRARTPFIMSSLMSDFIFPTQSLLFENCQTVALSATPTTSVIRSIPGADIELNRQSLLSRGFLLIAASISATPVVSRGAQEDIEEYSADSLISRREHWRLLSPSMSPIFPAKVIISKQVTILNSSALHRFSTKAFNPSEYQAITEASSNQRLTNIKSQAADSLRELSQTCATCSMTEIKSSREFSDQVLHSKQSHFYETFWMNSAILASWYALMGAQTITSGHSFSSATEITPSVAFTEVPSLFPSKKSAKRTILSSSLEESITLSSNLDVNLCLDKTCLSIVPSQTISSDLMNSDLTSKMTTDELSVSENILKLLKIRQYGITMGPTEVLNQESLLDMEKSKGSHTLFKLHPSDSSLDFELNLQIYPDVTLKTYSEITHANDFKNNLPPLTGSVPDFSEVTTNVAFYTVSATPALSIQTSSSMSVIRPDWPYFTDYMTSLKKEVKTSSEWSKWELQPSVQYQEFPTASRHLPFTRSLTLSSLESILAPQRLMISDFSCVRYYGDSYLEFQNVALNPQNNISLEFQTFSSYGLLLYVKQDSNLVDGFFIQLFIENGTLKYHFYCPGEAKFKSINTTVRVDNGQKYTLLIRQELDPCNAELTILGRNTQICESINHVLGKPLPKSGSVFIGGFPDLHGKIQMPVPVKNFTGCIEVIEINNWRSFIPSKAVKNYHINNCRSQGFMLSPTASFVDASDVTQGVDTMWTSVSPSVAAPSVCQQDVCHNGGTCHAIFLSSGIVSFQCDCPLHFTGRFCEKDAGLFFPSFNGNSYLELPFLKFVLEKEHNRTVTIYLTIKTNSLNGTILYSNGNNCGKQFLHLFLVEGRPSVKYGCGNSQNILTVSANYSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQALILIVILEKPKPAERKVKKEALSISDPSFRSNELSWMSFASFHVRKKTHIQLQFQPLAADGILFYAAQHLKAQSGDFLCISLVNSSVQLRYNLGDRTIILETLQKVTINGSTWHIIKAGRVGAEGYLDLDGINVTEKASTKMSSLDTNTDFYIGGVSSLNLVNPMAIENEPVGFQGCIRQVIINNQELQLTEFGAKGGSNVGDCDGTACGYNTCRNGGECTVNGTTFSCRCLPDWAGNTCNQSVSCLNNLCLHQSLCIPDQSFSYSCLCTLGWVGRYCENKTSFSTAKFMGNSYIKYIDPNYRMRNLQFTTISLNFSTTKTEGLIVWMGIAQNEENDFLAIGLHNQTLKIAVNLGERISVPMSYNNGTFCCNKWHHVVVIQNQTLIKAYINNSLILSEDIDPHKNFVALNYDGICYLGGFEYGRKVNIVTQEIFKTNFVGKIKDVVFFQEPKNIELIKLEGYNVYDGDEQNEVT

SEQ ID NO: 28080 - protein, 473 aa, Homo sapiens
  ENSP00000381585
  MOD_RES (1)..(1): Any amino acid
XSINTNAFTPITIRYTTPVGSPGVVCMIEMTADGKPPVQKKDTEISHASQAYFESMFLGHIPANVQIHKKAGPVYGFRGCILDLQVNNKEFFIIDEARHGKNIENCHVPWCAHHLCRNNGTCISDNENLFCECPRLYSGKLCQFASCENNPCGNGATCVPKSGTDIVCLCPYGRSGPLCTDAINITQPRFSGTDAFGYTSFLAYSRISDISFHYEFHLKFQLANNHSALQNNLIFFTGQKGHGLNGDDFLAVGLLNGSVVYSYNLGSGIASIRSEPLNLSLGVHTVHLGKFFQEGWLKVDDHKNKSIIAPGRLVGLNVFSQFYVGGYSEYTPDLLPNGADFKNGFQGCIFTLQVRTEKDGHFRGLGNPEGHPNAGRSVGQCHASPCSLMKCGNGGTCIESGTSVYCNCTTGWKGSFCTETVSTCDPEHDPPHHCSRGATCISLPHGYTCFCPLGTTGIYCEQGHQFIGKDVFK

SEQ ID NO: 28081 - protein, 619 aa, Homo sapiens
  ENSP00000377042
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRRILNTVIPHQIQQHIERFIQHDQVGFIVRI

SEQ ID NO: 28082 - protein, 594 aa, Homo sapiens
  ENSP00000341818
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRYLCII

SEQ ID NO: 28083 - protein, 152 aa, Homo sapiens
  ENSP00000420530
MNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGLLGGK

SEQ ID NO: 28084 - protein, 295 aa, Homo sapiens
  ENSP00000334145
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 28085 - protein, 238 aa, Homo sapiens
  ENSP00000359226
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKYSTSLELWYLWSSSLSSSWLYLYTSVERQEWGRAGRRTPH

SEQ ID NO: 28086 - protein, 372 aa, Homo sapiens
  ENSP00000219368
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 28087 - protein, 156 aa, Homo sapiens
  ENSP00000455126
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKSTRWQCPSPCSPGSSCWGHSSGASSSTSSTASCST

SEQ ID NO: 28088 - protein, 192 aa, Homo sapiens
  ENSP00000464576
MPSFQLPAMATSTMASFSHKDTEKGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHG

SEQ ID NO: 28089 - protein, 18 aa, Homo sapiens
  ENSP00000479548
  MOD_RES (1)..(1): Any amino acid
XLFTSFTTGNASFFPDLP

SEQ ID NO: 28090 - protein, 384 aa, Homo sapiens
  ENSP00000362187
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 28091 - protein, 242 aa, Homo sapiens
  ENSP00000362176
MFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDLTHRRNTSTSSSASGGLGMTVEGPEGSEREHRPPEKPPRPPRPLHLSDRSFRRKKDSVESHPTWVDDTRIDADAIVEKIVQSQDFTDGSNTEDSNLRLFVSRDGSATLSGIQLATRVSSGVYEPVVIESH

SEQ ID NO: 28092 - protein, 360 aa, Homo sapiens
  ENSP00000359052
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNRVGSGAYEQVVIKR

SEQ ID NO: 28093 - protein, 355 aa, Homo sapiens
  ENSP00000386084
MMKKKKFKFKVDFELEELSSVPFVNGVLFCKMRLLDGGSFTAESSREVVQANCVRWRKKFSFMCKMSASAATGILDPCIYRVSVRKELKGGKAYAKLGFADLNLAEFAGSGNTTRRCLLEGYDTKNTRQDNSILKVLISMQLMSGDPCFKTPPSTSMSIPIAGESESLQEDRKGGETLKVHLGIADLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKRVDDTRVDADDIVEKILQSQDFSLDSSAEEEGLRLFVGPGGSTTFGSHHLPNSALEAPSLL

SEQ ID NO: 28094 - protein, 144 aa, Homo sapiens
  ENSP00000354270
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 28095 - protein, 144 aa, Homo sapiens; identical to SEQ ID NO: 28094
  ENSP00000377991

SEQ ID NO: 28096 - protein, 135 aa, Homo sapiens
  ENSP00000419529
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQVGDGHPAGTTHPPGLSSREELCCGHS

SEQ ID NO: 28097 - protein, 175 aa, Homo sapiens
  ENSP00000419124
MGAAQGKKKTYSPQARFHSENEKQRRNGSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 28098 - protein, 172 aa, Homo sapiens
  ENSP00000400858
MAQRLGEWARGPSDATGLYRAVLLRSAAMYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 28099 - protein, 105 aa, Homo sapiens
  ENSP00000418038
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQ

SEQ ID NO: 28100 - protein, 131 aa, Homo sapiens
  ENSP00000367731
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 28101 - protein, 306 aa, Homo sapiens
  ENSP00000181796
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 28102 - protein, 131 aa, Homo sapiens; identical to SEQ ID NO: 28100
  ENSP00000418120

SEQ ID NO: 28103 - protein, 131 aa, Homo sapiens; identical to SEQ ID NO: 28100
  ENSP00000367728

SEQ ID NO: 28104 - protein, 160 aa, Homo sapiens
  ENSP00000420273
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSGECS

SEQ ID NO: 28105 - protein, 131 aa, Homo sapiens; identical to SEQ ID NO: 28100
  ENSP00000367726

SEQ ID NO: 28106 - protein, 131 aa, Homo sapiens; identical to SEQ ID NO: 28100
  ENSP00000367719

SEQ ID NO: 28107 - protein, 131 aa, Homo sapiens; identical to SEQ ID NO: 28100
  ENSP00000417782

SEQ ID NO: 28108 - protein, 131 aa, Homo sapiens; identical to SEQ ID NO: 28100
  ENSP00000367723

SEQ ID NO: 28109 - protein, 51 aa, Homo sapiens
  ENSP00000418365
MAEPDYIEDDNPELIRPQKLINPVKTSRNHQDLHRELLMNQKRILVWLEIH

SEQ ID NO: 28110 - protein, 131 aa, Homo sapiens; identical to SEQ ID NO: 28100
  ENSP00000418330

SEQ ID NO: 28111 - protein, 131 aa, Homo sapiens; identical to SEQ ID NO: 28100
  ENSP00000419603

SEQ ID NO: 28112 - protein, 130 aa, Homo sapiens
  ENSP00000420444
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQE

SEQ ID NO: 28113 - protein, 128 aa, Homo sapiens
  ENSP00000413676
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQA

SEQ ID NO: 28114 - protein, 126 aa, Homo sapiens
  ENSP00000420249
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVA

SEQ ID NO: 28115 - protein, 124 aa, Homo sapiens
  ENSP00000418395
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQE

SEQ ID NO: 28116 - protein, 101 aa, Homo sapiens
  ENSP00000417242
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKL

SEQ ID NO: 28117 - protein, 93 aa, Homo sapiens
  ENSP00000420314
MAEPDYIEDDNPELIRPQKLINPVKTSRNHQDLHRELLMNQKRGLAPQNKPELQKVMEKRKRDQVIKQKEEEAQKKKSDLEIELLKRQQKLEQ

SEQ ID NO: 28118 - protein, 90 aa, Homo sapiens
  ENSP00000397949
MAEPDYIEDDNPELIRPQKLINPVKTSRNHQDLHRELLMNQKRGLAPQNKPELQKVMEKRKRDQVIKQKEEEAQKKKSDLEIELLKRQQK

SEQ ID NO: 28119 - protein, 84 aa, Homo sapiens
  ENSP00000417845
MAEPDYIEDDNPELIRPQKLINPVKTSRNHQDLHRELLMNQKRGLAPQNKPELQKVMEKRKRDQVIKQKEEEAQKKKSDLEIEL

SEQ ID NO: 28120 - protein, 67 aa, Homo sapiens
  ENSP00000419064
MAEPDYIEDDNPELIRPQKLINPVKTSRNHQDLHRELLMNQKRGLAPQNKPELQKVMEKRKRDQVIK

SEQ ID NO: 28121 - protein, 131 aa, Homo sapiens; identical to SEQ ID NO: 28100
  ENSP00000479842

SEQ ID NO: 28122 - protein, 133 aa, Homo sapiens
  ENSP00000422965
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSW

SEQ ID NO: 28123 - protein, 356 aa, Homo sapiens
  ENSP00000424115
MLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 28124 - protein, 563 aa, Homo sapiens
  ENSP00000351740
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLLSSASATVGHGLTAVKEKAGATLRIHGVNSGSSEGAQPNTENGVPEITDAATDQGPAESPPTSPSSASRGMLSAITNVVQNTGKSVLTGGLDALEFIGKKTMNVLAESDPGFKRTKTLMERTVSLSQMLREAKEKEKQRLAQQLTMERTAHYGMLFDEYQGLSHLEALEILSNESESKVQSFLASLDGEKLELLKNDLISIKDIFAAKELENEENQEEQGLEEKGEEFARMLTELLFELHVAATPDKLNKAMKRAHDWVEEDQTVVSVDVAKVSEEETKKEEKEEKSQDPQEDKKEEKKTKTIEEVYMSSIESLAEVTARCIEQLHKVAELILHGQEEEKPAQDQAKVLIKLTTAMCNEVASLSKKFTNSLTTVGSNKKAEVLNPMISSVLLEGCNSTTYIQDAFQLLLPVLQVSHIQTSCLKAQP

SEQ ID NO: 28125 - protein, 453 aa, Homo sapiens
  ENSP00000240364
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 28126 - protein, 181 aa, Homo sapiens
  ENSP00000465808
MSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 28127 - protein, 55 aa, Homo sapiens
  ENSP00000467070
ASPPSFPSGSPVLRLSPCLHRSLEGLNQELEEVFVKEQGEEELLRSPGHRRSLPS

SEQ ID NO: 28128 - protein, 230 aa, Homo sapiens
  ENSP00000427326
MWLFFPLCYHPPTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREP

SEQ ID NO: 28129 - protein, 223 aa, Homo sapiens
  ENSP00000421412
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSC

SEQ ID NO: 28130 - protein, 152 aa, Homo sapiens
  ENSP00000359821
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLNDNGLQKSSSLKCIDLTPVSSMASSIKKTGKSTSSYF

SEQ ID NO: 28131 - protein, 79 aa, Homo sapiens
  ENSP00000485120
MAQEKMKLGFKSLPSSTTADGNILRRVNSAPLINGLGFNSQVLQADMLRIRTNRTTFRNRRSLEITSPTSVEQKPKDLF

SEQ ID NO: 28132 - protein, 195 aa, Homo sapiens
  ENSP00000359820
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLVKWHFNINQKRFSKAQPTCFLLILPNCQKIMCIYFQLLLMETTAMLDLLVIRQLKSALSQTLLCHLLILVLICSSRQTFN

SEQ ID NO: 28133 - protein, 115 aa, Homo sapiens
  ENSP00000402477
MAYFPGTGRTDQETQLDLSLCGREPESLENLFLDPDMAQEKMKLGFKSLPSSTTADGNILRRVNSAPLINGLGFNSQVLQADMLRIRTNRTTFRNRRSLEITSPTSVEQKPKDLF

SEQ ID NO: 28134 - protein, 301 aa, Homo sapiens
  ENSP00000481212
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQVLGGRLSVCLGDLRNQLALPQTL

SEQ ID NO: 28135 - protein, 546 aa, Homo sapiens
  ENSP00000324625
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 28136 - protein, 582 aa, Homo sapiens
  ENSP00000280057
MDPKAGGGGEEDDCVDSGAETGGSDYSHLSSTSNGFSTWRMPCCLFLYCTHGDKEKGRWSLQVEHTWPSGELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDGNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 28137 - protein, 281 aa, Homo sapiens
  ENSP00000388551
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 28138 - protein, 251 aa, Homo sapiens
  ENSP00000414050
MAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTEGWLLPSRSLWVEPSLKGPCPAGLVLCFIHLSIVSKSSSFFLKTEGFWSVFSVGSSLLWEALE

SEQ ID NO: 28139 - protein, 281 aa, Homo sapiens; identical to SEQ ID NO: 28137
  ENSP00000340974

SEQ ID NO: 28140 - protein, 123 aa, Homo sapiens
  ENSP00000399875
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDT

SEQ ID NO: 28141 - protein, 231 aa, Homo sapiens
  ENSP00000414913
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLS

SEQ ID NO: 28142 - protein, 359 aa, Homo sapiens
  ENSP00000491845
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLGLAPALPEPMG

SEQ ID NO: 28143 - protein, 366 aa, Homo sapiens
  ENSP00000373360
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 28144 - protein, 281 aa, Homo sapiens; identical to SEQ ID NO: 28137
  ENSP00000390588

SEQ ID NO: 28145 - protein, 335 aa, Homo sapiens
  ENSP00000310135
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 28146 - protein, 217 aa, Homo sapiens
  ENSP00000425089
  MOD_RES (1)..(1): Any amino acid
XELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 28147 - protein, 356 aa, Homo sapiens
  ENSP00000382691
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 28148 - protein, 497 aa, Homo sapiens
  ENSP00000304642
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 28149 - protein, 1406 aa, Homo sapiens
  ENSP00000378710
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVIRCPEPGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFSFYQAKEKFKKELKIEGFLYSDLTVLASDIPYFPPEEEEENLEDGIHLVVCVHGLDGNSADLRLVKTFIELGLPGGKLDFLMSEKNQMDTFADFDTMTDRLLDEIIQHIQLYNLSISRISFIGHSLGNIIIRSVLTRPRFRYYLNKLHTFLSLSGPHLGTLYNNSTLVSTGLWLMQKLKKSGSLLQLTFRDNADLRKCFLYQLSQKTGLQYFKNVVLVASPQDRYVPFHSARIEMCKTALKDRHTGPVYAEMINNLLGPLVEAKDCTLIRHNVFHALPNTANTLIGRAAHIAVLDSELFLEKFFLVAGLNYFK

SEQ ID NO: 28150 - protein, 43 aa, Homo sapiens
  ENSP00000429874
MSEIQGTVEFSVELHKFYNVDLFQRGMQSEFGISRAGDISKSS

SEQ ID NO: 28151 - protein, 1141 aa, Homo sapiens
  ENSP00000276737
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVPVMFDYFHLSVISVTVHAALVALQQPLISFTRPGRGSWLGKGGPDTGQEQSIISLENLVFGAGYCKPTSSEGSFYITSENCMQHAHKWHRDLCLLLLHAYRGLRLHFLVIMRDIPELPHTELEALAVEETLSQLCSELQMLNNPEKIAEQISKDLAWLTSHMMTLWTQFLDTVTLHSQVTTYLTQEHHTLRVRRFSEAFFYMEHQKLAVLTFQENLIQTHSQLSLDIRNSEYLTSMPPLPAECLDIDGDWNTLPVIFEDRYVDCPATGHNLSVYPNFDVPVTSPTIMNLKDKEDNCMVNSNLSFREDLVLSTIKPSQMDSDEEVIRCPEPGENVATQNHMDMCSESQVYISIGEFQNKAGVPEDECWTGQTSDAGTYPVADVDTSRRSPGPEDGQAPVLTYIDVKSSNKNPSRAEPLVAFNAQHESRSSRDKYGLDRTGLSKVVVGGSHQNAISSDKTTLHELSTLGKGIDQEGKMVLLSLKLTPSEPCDPLSSTLREPLDIRSSLKDSHTEEQEELSVLSGVIKRSSSIISDSGIESEPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFRGRGRKFGRWNSPGCLCPWPGWEQCRPPAGKDFHRTGAPWRKTGLPNV

SEQ ID NO: 28152 - protein, 451 aa, Homo sapiens
  ENSP00000430088
EPSSVAWSEARSRALELPSDREVLHPFVRRHALHRNSLEGGHTESNTSLPSGIQASLTSISSLPFEEDEREVALTKLTKSVSAPHISSPEEAAEDADTKQQDGGFAEPSDMHSKSQGSPGSCSQLCGDSGTDAGADHPLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFRGRGRKFGRWNSPGCLCPWPGWEQCRPPAGKDFHRTGAPWRKTGLPNV

SEQ ID NO: 28153 - protein, 153 aa, Homo sapiens
  ENSP00000160713
MSEIQGTVEFSVELHKFYNVDLFQRGYYQIRVTLKVSSRIPHRLSASIAGQTESSSLHSACVHDSTVHSRVFQILYRNEEVPINDAVVFRVHLLLGGERMEDALSEVDFQLKVDLHFTDSEQQLRDVAGAPMVSSRTLGLHFHPRNGLHHQVP

SEQ ID NO: 28154 - protein, 68 aa, Homo sapiens
  ENSP00000428017
MSEIQGTVEFSVELHKFYNVDLFQRGYYQIRVTLKVSSRIPHRLSASIAGQTEVLNIHMSEQEPAQGK

SEQ ID NO: 28155 - protein, 214 aa, Homo sapiens
  ENSP00000284486
MSVPQIHVEEVGAEEGAGAAAPPDDHLRSLKALTEKLRLETRRPSYLEWQARLEEHTWPFPRPAAEPQASLEEGERGGQEPLLPLREAGQHPPSARSASQGARPLSTGKLEGFQSIDEAIAWLRKELTEMRLQDQQLARQLMRLRGDINKLKIEHTCRLHRRMLNDATYELEERDELADLFCDSPLASSFSLSTPLKLIGVTKMNINSRRFSLC

SEQ ID NO: 28156 - protein, 214 aa, Homo sapiens; identical to SEQ ID NO: 28155
  ENSP00000432232

SEQ ID NO: 28157 - protein, 214 aa, Homo sapiens; identical to SEQ ID NO: 28155
  ENSP00000436655

SEQ ID NO: 28158 - protein, 91 aa, Homo sapiens
  ENSP00000431951
MSVPQIHVEEVGAEEGAGAAAPPDDHLRSLKALTEKLRLETRRPSYLEWQARLEEHTWPFPRPAAEPQASLEEGERGGQEPLLPLREAGQH

SEQ ID NO: 28159 - protein, 826 aa, Homo sapiens
  ENSP00000304108
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 28160 - protein, 238 aa, Homo sapiens
  ENSP00000478477
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITQ

SEQ ID NO: 28161 - protein, 162 aa, Homo sapiens
  ENSP00000384897
MDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVL

SEQ ID NO: 28162 - protein, 69 aa, Homo sapiens
  ENSP00000402415
MGTRDDVPEAKVLVPVAVYCGSIPRTSAGPRVLPPGSINSSLPHGEGSLQPEPRALLNNEEPSQLLRGL

SEQ ID NO: 28163 - protein, 1019 aa, Homo sapiens
  ENSP00000368876
MGTRDDVPEAKVLVPVAVYCGSIPRTSAGPRVLPPGSINSSLPHGEGSLQPEPRALLNNEEPSQLLRGLGQLGGLKLDTPSKGWQARNGHPRNLRALSLGDQPLVLLPSPESEANSVARDTIQIKDKLKKRRLSEGLAASSRASLDPGGGPQGVPLHSTIPRATSQRLLRVPRPMPLIQSIPTTPEASGVKEKGLDLPGSIPGPHELRPGAQEAQISWQYLHCNDEKMQKSLGAIVIPPIPKARTVAATPSRVPGSLPSPLPPGQGVLTGLRAPRTRLARGSGPREKTPASLEPKPLASPIRDRPAAAKKPALPFSQSAPTLTAFSFDCAREACPPLKEEDQKEIGTKIQVTISKSAREKMQLKQMKEMELLRRLEEPRTGQELTSQCLGSQRAFMKEGLLPLRGSGTLSVPTRLSGPCRNDVSIILRKWASRASLPSIPISRQEPRFARHASANSLPAVLTLGSPEWEEEEEMDLRACKELRPFSNPELGLRDALQCLNSSDWQMKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGVYHRNPLIRKYAAEHLSAVLEQIGAEKLLSGTRDSTDMLVHNLVRLAQDSNQDTRFYGRKMVNILMANTKFDAFLKQSLPSYDLQKVMAAIKQQGIEDNDELPSAKGRKVLRSLVVCENGLPIKEGLSCNGPRLVGLRSTLQGRGEMVEQLRELTRLLEAKDFRSRMEGVGQLLELCKAKTELVTAHLVQVFDAFTPRLQDSNKKVNQWALESFAKMIPLLRESLHPMLLSIIITVADNLNSKNSGIYAAAVAVLDAMVESLDNLCLLPALAGRVRFLSGRAVLDVTDRLAVLVASVYPRKPQAVERHVLPILWHFLNTATRNGTLPGPSGNIRGVVCRLSRSLQEHMGSRLLDFAASQPKHVLKTLQELLDSESLGGSRKATDRGVAPDSKTTGSSYPFQLD

SEQ ID NO: 28164 - protein, 112 aa, Homo sapiens
  ENSP00000396739
MKEKGLVSIQRLAACHSEVLTGKLHDVCLVVTGEVTNLRSKVSHLAISTLGDLFQALKKNMDQEAEEIARCLLQKMADTNEFIQRAAGQSLRAMVENVTLARSLVVLTSAGV

SEQ ID NO: 28165 - protein, 479 aa, Homo sapiens
  ENSP00000429763
MVSKDTGKCILTTSESEVEPAACLALEMKYALDPNRQIKKRNKALQVRFKDICEAQNEQRDTQLSSGQLGEKREAKPVSCRAAYRKYMTVPARRSIPNVTKSTGVQTSPDLKKCYQTFPLDRKKGNLKSLPAADPFKSQNNGFLTDAKEKNEAGPMEEARPCGAGRVHKTTALVFHSNQHMNTVDQPLGVNCTEPCKSPEPLSYGEAALQNSTRPPSEEPDYQLLGRAKQDRGRPNSEEPAPPALRRVFKTEVATVYAPALSARAPEPGLSDSAAASQWSLCPADDERRRATHLNGLQAPSETALACSPPMQCLSPECSEQPSQTHTPPGLGNQPSPTAVAAGEECQRIVPHTEVVDLKAQLQMMENLISSSQETIKVLLGVIQELEKGEAHREGLSYRTGQDTANCDTCRNSACIIYSVELDFKQQEDKLQPVLRKLHPIEETQVIPSPYSQETYSSTPKQKSKTESKKHGRWKLWFL

SEQ ID NO: 28166 - protein, 455 aa, Homo sapiens
  ENSP00000428730
MVSKDTGKCILTTSESEVEPAACLALEMKYALDPNRQIKKRNKALQVRFKDICEAQNEQRDTQLSSGQLGEKREAKPVSCRAAYRKYMTVPARRSIPNVTKSTGVQTSPDLKKCYQTFPLDRKKGNLKSLPAADPFKSQNNGFLTDAKEKNEAGPMEEARPCGAGRVHKTTALVFHSNQHMNTVDQPLGVNCTEPCKSPEPLSYGEAALQNSTRPPSEEPDYQLLGRAKQDRGRPNSEEPAPPALRRVFKTEVATVYAPALSARAPEPGLSDSAAASQWSLCPADDERRRATHLNGLQAPSETALACSPPMQCLSPECSEQPSQTHTPPGLGNQPSPTAVAAGEECQRIVPHTEVVDLKAQLQMMENLISSSQETIKVLLGVIQELEKGEAHREGVELDFKQQEDKLQPVLRKLHPIEETQVIPSPYSQETYSSTPKQKSKTESKKHGRWKLWFL

SEQ ID NO: 28167 - protein, 455 aa, Homo sapiens; identical to SEQ ID NO: 28166
  ENSP00000479733

SEQ ID NO: 28168 - protein, 519 aa, Homo sapiens
  ENSP00000465976
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 28169 - protein, 519 aa, Homo sapiens; identical to SEQ ID NO: 28168
  ENSP00000296530

SEQ ID NO: 28170 - protein, 527 aa, Homo sapiens
  ENSP00000377396
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQAAAAACLSMRLAFFIFPAWEDMRVPGKCCIGHARLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 28171 - protein, 187 aa, Homo sapiens
  ENSP00000466811
MLLISETLQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWE

SEQ ID NO: 28172 - protein, 108 aa, Homo sapiens
  ENSP00000465491
MALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLF

SEQ ID NO: 28173 - protein, 191 aa, Homo sapiens
  ENSP00000468648
  MOD_RES (1)..(1): Any amino acid
XFSTHGSHLDSSSSSVSFHALGILYFPSLGGYESSREMLYWTCKNGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIK

SEQ ID NO: 28174 - protein, 331 aa, Homo sapiens
  ENSP00000466873
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQGNRFTCFVICSCWGFWFIFFFPSLSFSK

SEQ ID NO: 28175 - protein, 9 aa, Homo sapiens
  ENSP00000466595
MTCPDKPGQ

SEQ ID NO: 28176 - protein, 133 aa, Homo sapiens [sequence omitted]

SEQ ID NO: 28177 - protein, 133 aa, Homo sapiens [sequence omitted]

SEQ ID NO: 28178 - protein, 52 aa, Homo sapiens [sequence omitted]

SEQ ID NO: 28179 - protein, 140 aa, Homo sapiens
  ENSP00000295569
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 28180 - protein, 77 aa, Homo sapiens
  ENSP00000419439
MRSPRMRVCAKSVLLSHWLFLAYVLMVCCKLMSASSQHLRGHAGHHQIKQGTCEVVAVHRCCNKNRIEERSQTVKCS

SEQ ID NO: 28181 - protein, 57 aa, Homo sapiens
  ENSP00000489092
MRSPRMRVCAKSVLLSHWLFLAYVLMVCCKLMSASSQHLRGHAGHHQIKQGTCEVVA

SEQ ID NO: 28182 - protein, 541 aa, Homo sapiens
  ENSP00000468308
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 28183 - protein, 21 aa, Homo sapiens
  ENSP00000467884
QRHNAEIAAFHLDREYGPAPL

SEQ ID NO: 28184 - protein, 127 aa, Homo sapiens
  ENSP00000464910
  MOD_RES (1)..(1): Any amino acid
XFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRPQFLLLKGRGGVCDP

SEQ ID NO: 28185 - protein, 145 aa, Homo sapiens
  ENSP00000481085
MFTSPSEGKPGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 28186 - protein, 297 aa, Homo sapiens
  ENSP00000349805
MTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 28187 - protein, 114 aa, Homo sapiens
  ENSP00000436075
MTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLEQPEPTSGAFPIRCS

SEQ ID NO: 28188 - protein, 282 aa, Homo sapiens
  ENSP00000408238
MRQLMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 28189 - protein, 181 aa, Homo sapiens
  ENSP00000437205
MTMESREMDCYLRRLKQELAPCFLSPLQMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDL

SEQ ID NO: 28190 - protein, 136 aa, Homo sapiens
  ENSP00000463642
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPY

SEQ ID NO: 28191 - protein, 28 aa, Homo sapiens
  ENSP00000462540
MLACLPGPGDLSFQLLSHTQMNTGLQKL

SEQ ID NO: 28192 - protein, 28 aa, Homo sapiens
  ENSP00000463136
MLACLPGPGDLSFQLLSHTQMNTGLQKL

SEQ ID NO: 28193 - protein, 43 aa, Homo sapiens
  ENSP00000464019
MLACLPGPGDLSFQLLSHTQMNTGLQKWDTTQKMRTAHYPTPA

SEQ ID NO: 28194 - protein, 54 aa, Homo sapiens
  ENSP00000464291
MLACLPGPGDLSFQLLSHTQMNTGLQKSLFTISASVEAGQRKLINVDKCPLPYS

SEQ ID NO: 28195 - protein, 434 aa, Homo sapiens
  ENSP00000343115
MNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 28196 - protein, 179 aa, Homo sapiens
  ENSP00000464355
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIP

SEQ ID NO: 28197 - protein, 28 aa, Homo sapiens
  ENSP00000463278
MLACLPGPGDLSFQLLSHTQMNTGLQKL

SEQ ID NO: 28198 - protein, 136 aa, Homo sapiens; identical to SEQ ID NO: 28190
  ENSP00000464299

SEQ ID NO: 28199 - protein, 562 aa, Homo sapiens
  ENSP00000413645
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAPPNVTVSTSTIPLSMAATLQHSQPPDLSSIVHQINQFCQTRAGISTTSVCEGQIANPSPISRSLLINASTRVSTHSVPTPMPSCVVNPMEHTHAATAALPAAGPVNLPTGISRVPTGYPSDLKPVTWNQHQLAHLQQMCSEASGTPAPGLTGKHAAGRELAGPGFVGKAPAYPQELCLAQSFHLKPPLEKPTPSPPVNGMAAPLAYPNGHYFQPLWNNILPTPNSDSSGSQDLAMPFHGGQPTGAPLDCAAAPGAHYRAGTGGGPVASQNSLMQTVDYLSGDFQQACFREQSLAMLSKAHRAPGNRAPDPTESRSLHIQHPGYR

SEQ ID NO: 28200 - protein, 239 aa, Homo sapiens
  ENSP00000463296
MLACLPGPGDLSFQLLSHTQMNTGLQKWDTTQKMRTAHYPTPAELDAYAKKVANNPLTIKIFPNSVKVPQRKHVRRTVNGLDTSAQRYSPYPTQAATKAGLLAIVKVPAKSILKDFDGTRARLLPEAIMNPPVAPYATVAPSTLAHPQAQALARQQALQHAQTLAHAPPQTLQHPQGIPPPQALSHPQSLQQPQGLGHPQPMAQTQGLVHPQALAHQGLQHPHNPLLHGGRKMPDSDAP

SEQ ID NO: 28201 - protein, 28 aa, Homo sapiens
  ENSP00000462251
MLACLPGPGDLSFQLLSHTQMNTGLQKL

SEQ ID NO: 28202 - protein, 28 aa, Homo sapiens
  ENSP00000463753
MLACLPGPGDLSFQLLSHTQMNTGLQKL

SEQ ID NO: 28203 - protein, 28 aa, Homo sapiens
  ENSP00000462534
MLACLPGPGDLSFQLLSHTQMNTGLQKL

SEQ ID NO: 28204 - protein, 562 aa, Homo sapiens; identical to SEQ ID NO: 28199
  ENSP00000462419

SEQ ID NO: 28205 - protein, 423 aa, Homo sapiens
  ENSP00000371397
MLPWKKHKFELLAEAPPRQASKPKGYAVSLHYSALSSLARACPEGALSRVGSMFRSKRKKLHITSEDPTYTVLYLGNATTIQARGDGCTDLAVGKIWSKSEAGRQGTKMKLTVSAQGIRMVHAEERALRRPGHLYLLHRVTYCVADARLPKVFAWVYRHELKHKAVMLRCHAVLVSKPEKAQAMALLLYQTSANALAEFKRLKRRDDARHQQQELVGAHTIPLVPLRKLLLHGPCCYKPPVERSRSAPKLGSITEDLLGEQLEQELQEEEEEEQPEGCPEEEENRAAEGDPAEEEAEAQRALVVAMHFECGDLLDTLENGRGEALGGGGGSLGPGAGPPPLLLGSASDMKAELSQLISDLGELSFGNDVRTLQADLRVTRLLSGDSTGSESSIEGGGPDATSATAGDSSRQADGASADEPHSG

SEQ ID NO: 28206 - protein, 88 aa, Homo sapiens
  ENSP00000401884
  MOD_RES (1)..(1): Any amino acid
XKRIGVRDVRLNGSAASHVLHQDSGLGYKDLDLIFCADLRGEGEFQTVKDVVLDCLLDFLPEGVNKEKITPLTLKEESHTTTYFLNIS

SEQ ID NO: 28207 - protein, 461 aa, Homo sapiens
  ENSP00000358769
MHQRYFWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 28208 - protein, 442 aa, Homo sapiens
  ENSP00000318298
MAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 28209 - protein, 523 aa, Homo sapiens
  ENSP00000358771
MQMRRVWRTCRSGPRKRREARYKKSTEDIFPAQLLKLQRHERVWQQEPPVRDHRSWGGSGAGGVAGREWTDQGQVALGGHYMAEGEGYFAMSEDELACSPYIPLGGDFGGGDFGGGDFGGGDFGGGGSFGGHCLDYCESPTAHCNVLNWEQVQRLDGILSETIPIHGRGNFPTLELQPSLIVKVVRRRLAEKRIGVRDVRLNGSAASHVLHQDSGLGYKDLDLIFCADLRGEGEFQTVKDVVLDCLLDFLPEGVNKEKITPLTLKEAYVQKMVKVCNDSDRWSLISLSNNSGKNVELKFVDSLRRQFEFSVDSFQIKLDSLLLFYECSENPMTETFHPTIIGESVYGDFQEAFDHLCNKIIATRNPEEIRGGGLLKYCNLLVRGFRPASDEIKTLQRYMCSRFFIDFSDIGEQQRKLESYLQNHFVGLEDRKYEYLMTLHGVVNESTVCLMGHERRQTLNLITMLAIRVLADQNVIPNVANVTCYYQPAPYVADANFSNYYIAQVQPVFTCQQQTYSTWLPCN

SEQ ID NO: 28210 - protein, 86 aa, Homo sapiens
  ENSP00000404872
  MOD_RES (1)..(1): Any amino acid
XQDSGLGYKDLDLIFCADLRGEGEFQTVKDVVLDCLLDFLPEGVNKEKITPLTLKVFHRLLRHWRAAEKTGVLFAEPLCGIGRPQV

SEQ ID NO: 28211 - protein, 391 aa, Homo sapiens
  ENSP00000358458
MAEESSCTRDCMSFSVLNWDQVSRLHEVLTEVVPIHGRGNFPTLEITLKDIVQTVRSRLEEAGIKVHDVRLNGSAAGHVLVKDNGLGCKDLDLIFHVALPTEAEFQLVRDVVLCSLLNFLPEGVNKLKISPVTLKEAYVQKLVKVCTDTDRWSLISLSNKNGKNVELKFVDSIRRQFEFSVDSFQIILDSLLFFYDCSNNPISEHFHPTVIGESMYGDFEEAFDHLQNRLIATKNPEEIRGGGLLKYSNLLVRDFRPTDQEEIKTLERYMCSRFFIDFPDILEQQRKLETYLQNHFAEEERSKYDYLMILRRVVNESTVCLMGHERRQTLNLISLLALRVLAEQNIIPSATNVTCYYQPAPYVSDGNFSNYYVAHPPVTYSQPYPTWLPCN

SEQ ID NO: 28212 - protein, 324 aa, Homo sapiens
  ENSP00000429150
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 28213 - protein, 324 aa, Homo sapiens; identical to SEQ ID NO: 28212
  ENSP00000428117

SEQ ID NO: 28214 - protein, 324 aa, Homo sapiens; identical to SEQ ID NO: 28212
  ENSP00000429802

SEQ ID NO: 28215 - protein, 324 aa, Homo sapiens; identical to SEQ ID NO: 28212
  ENSP00000384880

SEQ ID NO: 28216 - protein, 324 aa, Homo sapiens; identical to SEQ ID NO: 28212
  ENSP00000429078

SEQ ID NO: 28217 - protein, 178 aa, Homo sapiens
  ENSP00000429978
MTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 28218 - protein, 324 aa, Homo sapiens; identical to SEQ ID NO: 28212
  ENSP00000430674

SEQ ID NO: 28219 - protein, 324 aa, Homo sapiens; identical to SEQ ID NO: 28212
  ENSP00000429499

SEQ ID NO: 28220 - protein, 178 aa, Homo sapiens; identical to SEQ ID NO: 28217
  ENSP00000430433

SEQ ID NO: 28221 - protein, 155 aa, Homo sapiens
  ENSP00000430806
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKVELSIGPDC

SEQ ID NO: 28222 - protein, 100 aa, Homo sapiens
  ENSP00000429051
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRL

SEQ ID NO: 28223 - protein, 98 aa, Homo sapiens
  ENSP00000430694
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQ

SEQ ID NO: 28224 - protein, 93 aa, Homo sapiens
  ENSP00000429074
MGNLLKVLTCTDLEQGPNFFLDFENAQPTESEKEIYNQVNVVLKDAEGILEDLQSYRGAGHEIREAIQHPADEKLQEKAWGAVVPLVGKLKKF

SEQ ID NO: 28225 - protein, 78 aa, Homo sapiens
  ENSP00000430127
MGNLLKVLTCTDLEQGPNFFLDFENAQPTESEKEIYNQVNVVLKDAEGILEDLQSYRGAGHEIREAIQHPADEKLQEK

SEQ ID NO: 28226 - protein, 68 aa, Homo sapiens
  ENSP00000429659
MGNLLKVLTCTDLEQGPNFFLDFENAQPTESEKEIYNQVNVVLKDAEGILEDLQSYRGAGHEIREAIQ

SEQ ID NO: 28227 - protein, 65 aa, Homo sapiens
  ENSP00000427994
MGNLLKVLTCTDLEQGPNFFLDFENAQPTESEKEIYNQVNVVLKDAEGILEDLQSYRGAGHEIRE

SEQ ID NO: 28228 - protein, 63 aa, Homo sapiens
  ENSP00000430434
MGNLLKVLTCTDLEQGPNFFLDFENAQPTESEKEIYNQVNVVLKDAEGILEDLQSYRGAGHEI

SEQ ID NO: 28229 - protein, 47 aa, Homo sapiens
  ENSP00000429860
MGNLLKVLTCTDLEQGPNFFLDFENAQPTESEKEIYNQVNVVLKDAE

SEQ ID NO: 28230 - protein, 45 aa, Homo sapiens
  ENSP00000430412
MGNLLKVLTCTDLEQGPNFFLDFENAQPTESEKEIYNQVNVVLKD

SEQ ID NO: 28231 - protein, 217 aa, Homo sapiens [sequence omitted]

SEQ ID NO: 28232 - protein, 218 aa, Homo sapiens
  ENSP00000492779
MQKASWRTCSHTEELATKYERAIQHPADEKLQEKAWGAVVPLVGKKEILRIFSEVRSSIKRSSGSLNKYPIFSHPASRARQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFLEGNGGCHNTL

SEQ ID NO: 28233 - protein, 156 aa, Homo sapiens
  ENSP00000423987
  MOD_RES (1)..(1): Any amino acid
XRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQVASRTVSPSMLP

SEQ ID NO: 28234 - protein, 360 aa, Homo sapiens
  ENSP00000419044
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSESTGSSTAPPTKRHCRSLSEPEELVRCRSPWRPGSSKVWTPVSKRRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQPHSCARECESRVRGLGVSLQHLSGPSSQSRGSTLNENKTPWFEMEGNLAPEDFKKFKKPLLPQLRR

SEQ ID NO: 28235 - protein, 398 aa, Homo sapiens
  ENSP00000418243
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSESTGSSTAPPTKRHCRSLSEPEELVRCRSPWRPGSSKVWTPVSKRRCDSGGSATRQGSPGAVLPRSAVWSTGPTSPATPRPSSASGGFVDSSEGSAGSGPLWCSAESCLPSTRRRPSLSQERLAGAGTPLPWASSSPTSTPALGGRRGLLRCRSQPCVLSGKRSRRKRRREEDARWTRPSLDFLKMTQTLKNSKSLCSLNYEDDDEDDTPVKTVLSSPCDSRGLPGITMPGCSQRGLRTSPVHPNLWASRESVTSDGSRRSSGDPRDGDSVGEEGVFPRARWELDLEQIENN

SEQ ID NO: 28236 - protein, 398 aa, Homo sapiens; identical to SEQ ID NO: 28235
  ENSP00000426260

SEQ ID NO: 28237 - protein, 108 aa, Homo sapiens
  ENSP00000417615
MVTLITEKLQSQSLDDLTCKAEAGPLQYSAETLNKSGRLFPLELNDQSPWKVFSGGPPVRSQAATGPDFSFLPGLSAAAHTMGLQWQPQSPRPGAGLGAASTVDPSES

SEQ ID NO: 28238 - protein, 398 aa, Homo sapiens; identical to SEQ ID NO: 28235
  ENSP00000310057

SEQ ID NO: 28239 - protein, 428 aa, Homo sapiens
  ENSP00000359333
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 28240 - protein, 369 aa, Homo sapiens
  ENSP00000482718
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 28241 - protein, 383 aa, Homo sapiens
  ENSP00000484866
MARSLCPGAWLRKPYYLQCDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 28242 - protein, 162 aa, Homo sapiens
  ENSP00000483279
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKDQHR

SEQ ID NO: 28243 - protein, 403 aa, Homo sapiens
  ENSP00000482478
MKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 28244 - protein, 615 aa, Homo sapiens
  ENSP00000481110
MARACLIQRLPIKRDCTPVFVRGLSSPSAAMALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 28245 - protein, 585 aa, Homo sapiens
  ENSP00000481465
MALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFTWTDGKLNSSNLVILSGQVVEHFDLEFRILYAQSKPISPKLLSHFQSSNKFDHLTNRKPQSKELTLGNLLRMRLARLSSTPRKADLDPEMPAEGKAERKPHDCESSTVSEEDYFSSHRDELQSRKAIDAATQTEPGEEMPGLSVSEVGTQTSITTACAGTQTAVITRIASSQTTIWSRSTTTQTDMDENILFPRGTQSTEGSPVSKMSVSRSSSLKSSSSVSSQGSVASSTGSPASIRTTDFHNPGYPKYLGTPHLELYLSDSLRNLNKERQFHFAGIRSRLNHMLAMLSRRTLFTENHLGLHSGNFSRVNLLAVRDVALYPSYQ

SEQ ID NO: 28246 - protein, 292 aa, Homo sapiens
  ENSP00000295092
MGNQLDRITHLNYSELPTGDPSGIEKDELRVGVAYFFSDDEEDLDERGQPDKFGVKAPPGCTPCPESPSRHHHHLLHQLVLNETQFSAFRGQECIFSKVSGGPQGADLSVYAVTALPALCEPGDLLELLWLQPAPEPPAPAPHWAVYVGGGQIIHLHQGEIRQDSLYEAGAANVGRVVNSWYRYRPLVAELVVQNACGHLGLKSEEICWTNSESFAAWCRFGKREFKAGGEVPAGTQPPQQQYYLKVHLGENKVHTARFHSLEDLIREKRRIDASGRLRVLQELADLVDDKE

SEQ ID NO: 28247 - protein, 292 aa, Homo sapiens; identical to SEQ ID NO: 28246
  ENSP00000330681

SEQ ID NO: 28248 - protein, 184 aa, Homo sapiens
  ENSP00000355614
MSGARAAPGAAGNGAVRGLRVDGLPPLPKSLSGLLHSASGGGASGGWRHLERLYAQKSRIQDELSRGGPGGGGARAAALPAKPPNLDAALALLRKEMVGLRQLDMSLLCQLYSLYESIQEYKGACQAASSPDCTYALENGFFDEEEEYFQEQNSLHDRRDRGPPRDLSLPVSSLSSSDWILESI

SEQ ID NO: 28249 - protein, 304 aa, Homo sapiens
  ENSP00000443411
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 28250 - protein, 205 aa, Homo sapiens
  ENSP00000478373
  MOD_RES (1)..(1): Any amino acid
XPLKLYGAQIKQTRAEIKKFKHVQNHEIKQLEKLEKLRQKSPSDQQMISQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQSAQSTIWSPGKEGEESEDNSMEEAPVEDLRALGQGPHKRELPTTVRRT

SEQ ID NO: 28251 - protein, 304 aa, Homo sapiens
  ENSP00000487117
MNIVFSRDSQVRVMENTVANTEKYFGQFCSLLAAYTRKTARLRDKADQLVKQLIDFANSENPELRATMRGFAEDLAKVQDYRQAQVERLETKVVNPLKLYGAQIKQTRAEIKKFKHVQNHEIKQLEKLEKLRQKSPSDQQMIGQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHGRFSLCEWVVKGQPAHCVCGQGGHLMLPGHSL

SEQ ID NO: 28252 - protein, 44 aa, Homo sapiens
  ENSP00000450117
MQELLSCTNIIFHCAATVRFDDTLRHAVQLNVTATRQLLLMASQ

SEQ ID NO: 28253 - protein, 515 aa, Homo sapiens
  ENSP00000443291
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 28254 - protein, 515 aa, Homo sapiens; identical to SEQ ID NO: 28253
  ENSP00000182377

SEQ ID NO: 28255 - protein, 418 aa, Homo sapiens
  ENSP00000449349
MQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 28256 - protein, 67 aa, Homo sapiens
  ENSP00000449436
MSTIAAFYGGKSILITGATGFLGKVLMEKLFRTSPDLKVIYILVRPKAGQTLQQRVFQILDSKFESY

SEQ ID NO: 28257 - protein, 85 aa, Homo sapiens
  ENSP00000449187
LSPEDQRVFNFDVRQLNWLEYIENYVLGVKKYLLKEDMAGIPKAKQRLKRLRNIHYLFNTALFLIAWRLLIARSQMARNVWFFIM

SEQ ID NO: 28258 - protein, 22 aa, Homo sapiens
  ENSP00000447467
  MOD_RES (1)..(1): Any amino acid
XMAGIPKAKQRLKRSCTPYSTL

SEQ ID NO: 28259 - protein, 1076 aa, Homo sapiens
  ENSP00000471242
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRPGSFSLIRTPHLGQARRIPCAPERRPLLLVKEFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 28260 - protein, 1045 aa, Homo sapiens
  ENSP00000322926
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 28261 - protein, 801 aa, Homo sapiens
  ENSP00000490391
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGPASRAARGSSTSIPFIDCSDVDSEYDLLREQASRSRSRSRSRSQTNDNYEGDLTSGVYLLSREEGRREAGRRASPHSAKSSRPPSGEFLDDDSADITFDMSGSPRLPRHSSLIDEMFKGSAGHSPLATPLSPSSSSSSPNMSWDRTGSQGYVSENGHDHREGSMGEDTLPDQGPPYERWSPTSPRPYMRNLPGRCNKSETDPLILSQVAFTPEAMDGLGGRGKWGQASAAAPEGRSLANGTPPMGAASKVPAVQSVCARGMAGQLAPLQVTEGSTSSGTESSESDSEMLIPGSQPLIFGNPAVLRSPSLLRSRGSLGGLRLSEEQEEDE

SEQ ID NO: 28262 - protein, 129 aa, Homo sapiens
  ENSP00000365765
MGEIEQRPTPGSRLGAPENSGISTLERGQKPPPTPSGKLVSIKIQMLDDTQEAFEVPMVSSSSFLKATGSSWTGWVLRCSMKPKHHSHLIEKFGEDRILTHLTGSISYTNWAGSRSLAVTVTEELLNLF

SEQ ID NO: 28263 - protein, 203 aa, Homo sapiens
  ENSP00000469712
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNH

SEQ ID NO: 28264 - protein, 171 aa, Homo sapiens
  ENSP00000472346
  MOD_RES (1)..(1): Any amino acid
XYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANFLGWPGARSRGRLHRETT

SEQ ID NO: 28265 - protein, 215 aa, Homo sapiens
  ENSP00000410930
HLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRVSSSGLTMHCAGSRKEASEGLTFEPFEERPLQSKMSSFHPPGRQLEKHNSVVSSESLCSEEIKQSSDLIFCFFSLRGDSLLYLFPYHIPQKI

SEQ ID NO: 28266 - protein, 248 aa, Homo sapiens
  ENSP00000469365
  MOD_RES (1)..(1): Any amino acid
XEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGRFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHR

SEQ ID NO: 28267 - protein, 1076 aa, Homo sapiens; identical to SEQ ID NO: 28259
  ENSP00000486285

SEQ ID NO: 28268 - protein, 4588 aa, Homo sapiens
  ENSP00000406229
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 28269 - protein, 368 aa, Homo sapiens
  ENSP00000424157
  MOD_RES (1)..(1): Any amino acid
XDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNESLAAPDLSKPRGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 28270 - protein, 285 aa, Homo sapiens
  ENSP00000423801
  MOD_RES (1)..(1): Any amino acid
XSTTEALFASVEDYILVRGVSLVHTAKMNPVRMAEHALTVWMAPFVSVIRVLGEKGVRVISTSALETLACTGPSVRTRTAPITATAATSTGDVTARMLRPTTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHA

SEQ ID NO: 28271 - protein, 52 aa, Homo sapiens
  ENSP00000421003
MTMAVIVRNKEKKVIFEFSGQISGSSFRSHFPPLPYSILFVVHTFLSHLELS

SEQ ID NO: 28272 - protein, 119 aa, Homo sapiens
  ENSP00000420869
LSKKPLEEKPSQPYSARESLSEVQSLSSFQSESCDDNASIVTVMHLVNAVVDTVSTEESLAAPDLSKPRGYHWDTSDWMPSVPLPDIQEFPNYEVIDEQTPLYSADPNAIDTDYYPGGY

SEQ ID NO: 28273 - protein, 488 aa, Homo sapiens
  ENSP00000423736
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAV

SEQ ID NO: 28274 - protein, 4590 aa, Homo sapiens
  ENSP00000479573
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVPAHLTVMVRDQDVPVKRNFARIVVNVSDTNDHAPWFTASSYKGRVYESAAVGSVVLQVTALDKDKGKNAEVLYSIESGTFGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 28275 - protein, 1122 aa, Homo sapiens
  ENSP00000429678
  MOD_RES (1)..(1): Any amino acid
XGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 28276 - protein, 4349 aa, Homo sapiens
  ENSP00000261800
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 28277 - protein, 4439 aa, Homo sapiens
  ENSP00000432586
MNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNASIVTVIQLVNNVVDTIENEVSVMDQGQNYNRAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 28278 - protein, 892 aa, Homo sapiens
  ENSP00000436399
MHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 28279 - protein, 4557 aa, Homo sapiens
  ENSP00000387040
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 28280 - protein, 4557 aa, Homo sapiens; identical to SEQ ID NO: 28279
  ENSP00000489369

SEQ ID NO: 28281 - protein, 4439 aa, Homo sapiens; identical to SEQ ID NO: 28277
  ENSP00000489343

SEQ ID NO: 28282 - protein, 892 aa, Homo sapiens; identical to SEQ ID NO: 28278
  ENSP00000488913

SEQ ID NO: 28283 - protein, 1231 aa, Homo sapiens
  ENSP00000384169
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDQDECLMGAHDCSRRQFCVNTLGSFYCVNHTVLCADGYILNAHRKCVDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 28284 - protein, 1184 aa, Homo sapiens
  ENSP00000295760
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 28285 - protein, 158 aa, Homo sapiens
  ENSP00000420164
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCR

SEQ ID NO: 28286 - protein, 1231 aa, Homo sapiens; identical to SEQ ID NO: 28283
  ENSP00000420042

SEQ ID NO: 28287 - protein, 109 aa, Homo sapiens
  ENSP00000295761
  MOD_RES (1)..(1): Any amino acid
XIDECAQGAGILCTFRCLNVPGSYQCACPEQGYTMTANGRSCKDVDECALGTHNCSEAETCHNIQGSFRCLRFECPPNYVQVSKTWCVPTQAPSGSLHGGPRPWRVPCG

SEQ ID NO: 28288 - protein, 101 aa, Homo sapiens
  ENSP00000399224
  MOD_RES (1)..(1): Any amino acid
XVDECALGTHNCSEAETCHNIQGSFRCLRFECPPNYVQVSKTKCERTKWKLARWATAVAGALWVRLGDDLRTRDTRPCWGSWTPLDDPSPKLTFHFMFHCD

SEQ ID NO: 28289 - protein, 2871 aa, Homo sapiens
  ENSP00000325527
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 28290 - protein, 853 aa, Homo sapiens
  ENSP00000453958
  MOD_RES (1)..(1): Any amino acid
XLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDVILSLLLLSPAFPSCFFSPRTIGKGTASQRCYKTCVRSAPATGTPSPNRNAAVTEGEAGVPTVRSALSRGLWLSRNSVPMAEDS

SEQ ID NO: 28291 - protein, 302 aa, Homo sapiens
  ENSP00000440294
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATTSMNVKLEHTTVANMLYVPIQQEASNVAAVPGGLEMALSALIWTNVPMEPICAASMQTARIPWDLTAVCARKDTQVMASLVQTLMSALRT

SEQ ID NO: 28292 - protein, 55 aa, Homo sapiens
  ENSP00000453901
MRRGRLLEIALGFTVLLASYTSHGADANLEAGNVKETRASRAKRRGGGGHDALKG

SEQ ID NO: 28293 - protein, 2912 aa, Homo sapiens
  ENSP00000424571
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 28294 - protein, 356 aa, Homo sapiens
  ENSP00000426839
MMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 28295 - protein, 1473 aa, Homo sapiens
  ENSP00000425596
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVLQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 28296 - protein, 341 aa, Homo sapiens
  ENSP00000424753
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEVHVDKAQAGARCPCVILPSRLYLR

SEQ ID NO: 28297 - protein, 2912 aa, Homo sapiens; identical to SEQ ID NO: 28293
  ENSP00000262464

SEQ ID NO: 28298 - protein, 2911 aa, Homo sapiens
  ENSP00000482132
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCITQPCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 28299 - protein, 130 aa, Homo sapiens
  ENSP00000419587
MEGRCCRAGEISGEVSTGSPQKREEDVCQCRPECSQVKRSCPSCGSELGVEEKRGKGNPISIQLFPPELVEHIISFLPVRDLVALGQTCRYFHEVCDGEGVWRRICRRLSPRLQDQGSGVRPWKRAAILN

SEQ ID NO: 28300 - protein, 580 aa, Homo sapiens
  ENSP00000241071
MGEKAVPLLRRRRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 28301 - protein, 37 aa, Homo sapiens
  ENSP00000418814
MGEKAVPLLRRRRTRRACISRHLEAAADVSARAWPPC

SEQ ID NO: 28302 - protein, 318 aa, Homo sapiens
  ENSP00000419602
MGEKAVPLLRRRRVKRSCPSCGSELGVEEKRGKGNPISIQLFPPELVEHIISFLPVRDLVALGQTCRYFHEVCDGEGVWRRICRRLSPRLQDQDTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDPILCSWLQPPWPGG

SEQ ID NO: 28303 - protein, 187 aa, Homo sapiens
  ENSP00000417179
MNAEPLAGRERSSPLQWRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCR

SEQ ID NO: 28304 - protein, 568 aa, Homo sapiens
  ENSP00000420239
MVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 28305 - protein, 618 aa, Homo sapiens
  ENSP00000416558
MVWESQQERGGQGPRRQEGRSREGAIRMVRGSQRRKLQKFTRLCGREEGLRVKRSCPSCGSELGVEEKRGKGNPISIQLFPPELVEHIISFLPVRDLVALGQTCRYFHEVCDGEGVWRRICRRLSPRLQDQGSGVRPWKRAAILNYTKGLYFQAFGGRRRCLSKSVAPLLAHGYRRFLPTKDHVFILDYVGTLFFLKNALVSTLGQMQWKRACRYVVLCRGAKDFASDPRCDTVYRKYLYVLATREPQEVVGTTSSRACDCVEVYLQSSGQRVFKMTFHHSMTFKQIVLVGQETQRALLLLTEEGKIYSLVVNETQLDQPRSYTVQLALRKVSHYLPHLRVACMTSNQSSTLYVTDQGGVYFEVHTPGVYRDLFGTLQAFDPLDQQMPLALSLPAKILFCALGYNHLGLVDEFGRIFMQGNNRYGQLGTGDKMDRGEPTQVCYLQRPITLWCGLNHSLVLSQSSEFSKELLGCGCGAGGRLPGWPKGSASFVKLQVKVPLCACALCATRECLYILSSHDIEQHAPYRHLPASRVVGTPEPSLGARAPQDPGGMAQACEEYLSQIHSCQTLQDRTEKMKEIVGWMPLMAAQKDFFWEALDMLQRAEGGGGGVGPPAPET

SEQ ID NO: 28306 - protein, 355 aa, Homo sapiens
  ENSP00000428205
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 28307 - protein, 262 aa, Homo sapiens
  ENSP00000390790
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 28308 - protein, 193 aa, Homo sapiens
  ENSP00000485109
  MOD_RES (1)..(1): Any amino acid
XNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGTPLPPCCPPRS

SEQ ID NO: 28309 - protein, 566 aa, Homo sapiens
  ENSP00000313034
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVADCSRFDSPDLLLEAGDPATSPCRIFDLGSDNEEVVAGPAPAHAKEGLRHFLDRVLEGRAQPQLSERMLETKVAELLAQGHTKPPERSATGAKSKYLIFTTGCLTYSPHQIGIKQILPHQMTTAGPVLGEGRGSDAFFDALDHVIDIHGHIIGMGLSPDNRYLYVNSRAWPNGAVVADPMQPPPIAEEIDLLVFDLKTMREVRRALRAHRAYTPNDECFFIFLDVSRDFVASGAEDRHGYIWDRHYNICLARLRHEDVVNSVVFSPQEQELLLTASDDATIKAWRSPRTMRVLQAPRPRPRTFFSWLASQRR

SEQ ID NO: 28310 - protein, 117 aa, Homo sapiens
  ENSP00000485322
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVK

SEQ ID NO: 28311 - protein, 200 aa, Homo sapiens
  ENSP00000404829
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKAITTAAPAEQIWSNDLTISLLHSADMRPYNWSYTQFSQFNKDDSLLLASGVFLGPHNSSSGEIAVISLDSFALLSRVRNKPYD

SEQ ID NO: 28312 - protein, 129 aa, Homo sapiens
  ENSP00000394011
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLH

SEQ ID NO: 28313 - protein, 172 aa, Homo sapiens
  ENSP00000465854
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEGWVTLSVGLPRSQRQLVGPAAAGDGVQPGSDQDLRH

SEQ ID NO: 28314 - protein, 458 aa, Homo sapiens
  ENSP00000376945
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRVRAPYPVVEEKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 28315 - protein, 478 aa, Homo sapiens
  ENSP00000465387
MELPLGRCDDSRTWDDDSDPESETDPDAQAKAYVARVLSPPKSGLAFSRPSQLSTPAASPSASEPRAASRVSAVSEPGLLSLPPELLLEICSYLDARLVLHVLSRVCHALRDLVSDHVTWRLRALRRKNFDWPAACIALEQHLSRWAEDGRWVEYFCLAEGHVASVDSVLLLQGGSLCLSGSRDRNVNLWDLRQLGTESNQVLIKTLGTKRNSTHEGWVWSLAAQDHRVCSGSWDSTVKLWDMAADGQQFGEIKASSAVLCLSYLPDILVTGTYDKKVTIYDPRDRMETRDALMGWGGPSRGSDIPPHRPITHEAGPALLKHQQLHSRPVLTLLADDRHIISGSEDHTLVVVDRRANSVLQRLQLDSYLLCMSYQEPQLWAGDNQGLLHVFANRNGCFQLIRSFDVGHSFPITGIQYSVGALYTTSTDKTIRVHVPTDPPRTICTRRHDNGLNRVCAEGNLVVAGSGDLSLEVWRLQA

SEQ ID NO: 28316 - protein, 321 aa, Homo sapiens
  ENSP00000264072
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 28317 - protein, 321 aa, Homo sapiens; identical to SEQ ID NO: 28316
  ENSP00000471974

SEQ ID NO: 28318 - protein, 159 aa, Homo sapiens
  ENSP00000472067
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQELNERNEASDLLERLREEVTKLRMELQVSSGFVCNTCPEKWINFQRKCYYFGKG

SEQ ID NO: 28319 - protein, 320 aa, Homo sapiens
  ENSP00000353178
MNPPSQEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 28320 - protein, 684 aa, Homo sapiens
  ENSP00000308978
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 28321 - protein, 764 aa, Homo sapiens
  ENSP00000386987
MQPPPRKVKVTQELKNIQVEQMTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSLKAAQLVDIELSPVSALRMTIAESRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 28322 - protein, 740 aa, Homo sapiens
  ENSP00000386722
MQPPPRKVKVTQELKNIQVEQMTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 28323 - protein, 101 aa, Homo sapiens
  ENSP00000386903
MPVISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 28324 - protein, 604 aa, Homo sapiens
  ENSP00000402972
MAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSLKAAQLVDIELSPVSALRMTIAESRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 28325 - protein, 515 aa, Homo sapiens
  ENSP00000386314
MQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASGKD

SEQ ID NO: 28326 - protein, 117 aa, Homo sapiens
  ENSP00000406420
  MOD_RES (1)..(1): Any amino acid
XVLNDLECHGAAVSEQSRAELEQKIDEARENIRKAEIIKLKAEARLDLLKQIGVSVDTWLKSAMNQVMEELENERWARPPAVTSNGTLHSIPKEKKAKSLKITWMFSMTAVPALLAP

SEQ ID NO: 28327 - protein, 85 aa, Homo sapiens
  ENSP00000441616
  MOD_RES (1)..(1): Any amino acid
XEQMAHAVREKADIEAKSKLSLFQSRISLQKASVKLKARRSECNSKATHARNDYLLTLAAANAHQDRYYQTDLVNIMKVRQTFVI

SEQ ID NO: 28328 - protein, 140 aa, Homo sapiens
  ENSP00000408706
MTKLQAKHQAECDLLEDMRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQM

SEQ ID NO: 28329 - protein, 150 aa, Homo sapiens
  ENSP00000431852
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRM

SEQ ID NO: 28330 - protein, 417 aa, Homo sapiens
  ENSP00000220584
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28331 - protein, 374 aa, Homo sapiens
  ENSP00000390367
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28332 - protein, 67 aa, Homo sapiens
  ENSP00000433985
MEFVKCLGHPEEFYNLVRFRIGGKRKVMPKMDQTGGSWRARRRIARCWRTSQRSPLSLEIWLRNTKQ

SEQ ID NO: 28333 - protein, 45 aa, Homo sapiens
  ENSP00000432551
MEFVKCLGHPEEFYNLVRFRIGGKRKVMPKMDQITSHEGRFWNEV

SEQ ID NO: 28334 - protein, 51 aa, Homo sapiens
  ENSP00000434770
MEFVKCLGHPEEFYNLVRFRIGGKRKVMPKMDQQRSVHILSGSPSSGHTGR

SEQ ID NO: 28335 - protein, 410 aa, Homo sapiens
  ENSP00000434714
MEFVKCLGHPEEFYNLVRFRIGGKRKDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28336 - protein, 353 aa, Homo sapiens
  ENSP00000431749
MRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28337 - protein, 353 aa, Homo sapiens; identical to SEQ ID NO: 28336
  ENSP00000432331

SEQ ID NO: 28338 - protein, 476 aa, Homo sapiens
  ENSP00000491537
MAAAACGTKAMALFKRTLVLSPAAAPRGPGAGTAPRGCCLPPAAWPCKDWPRGEGGRLWSRLPQSHSHSHSHSHSHSCSSTSPTAVCVVCPQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28339 - protein, 113 aa, Homo sapiens
  ENSP00000435900
MRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKPQSLKTP

SEQ ID NO: 28340 - protein, 332 aa, Homo sapiens
  ENSP00000431649
MTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 28341 - protein, 332 aa, Homo sapiens; identical to SEQ ID NO: 28340
  ENSP00000436069

SEQ ID NO: 28342 - protein, 353 aa, Homo sapiens; identical to SEQ ID NO: 28336
  ENSP00000485229

SEQ ID NO: 28343 - protein, 353 aa, Homo sapiens; identical to SEQ ID NO: 28336
  ENSP00000444248

SEQ ID NO: 28344 - protein, 417 aa, Homo sapiens; identical to SEQ ID NO: 28330
  ENSP00000480828

SEQ ID NO: 28345 - protein, 417 aa, Homo sapiens; identical to SEQ ID NO: 28330
  ENSP00000481481

SEQ ID NO: 28346 - protein, 353 aa, Homo sapiens; identical to SEQ ID NO: 28336
  ENSP00000484122

SEQ ID NO: 28347 - protein, 617 aa, Homo sapiens
  ENSP00000274457
MDLKTAVFNAARDGKLRLLTKLLASKSKEEVSSLISEKTNGATPLLMAARYGHLDMVEFLLEQCSASIEVGGSVNFDGETIEGAPPLWAASAAGHLKVVQSLLNHGASVNNTTLTNSTPLRAACFDGHLEIVKYLVEHKADLEVSNRHGHTCLMISCYKGHKEIAQYLLEKGADVNRKSVKGNTALHDCAESGSLDIMKMLLMYCAKMEKDGYGMTPLLSASVTGHTNIVDFLTHHAQTSKTERINALELLGATFVDKKRDLLGALKYWKKAMNMRYSDRTNIISKPVPQTLIMAYDYAKEVNSAEELEGLIADPDEMRMQALLIRERILGPSHPDTSYYIRYRGAVYADSGNFKRCINLWKYALDMQQSNLDPLSPMTASSLLSFAELFSFMLQDRAKGLLGTTVTFDDLMGILCKSVLEIERAIKQTQCPADPLQLNKALSIILHLICLLEKVPCTLEQDHFKKQTIYRFLKLHPRGKNNFSPLHLAVDKNTTCVGRYPVCKFPSLQVTAILIECGADVNVRDSDDNSPLHIAALNNHPDIMNLLIKSGAHFDATNLHKQTASDLLDEKEIAKNLIQPINHTTLQCLAARVIVNHRIYYKGHIPEKLETFVSLHR

SEQ ID NO: 28348 - protein, 677 aa, Homo sapiens
  ENSP00000217289
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 28349 - protein, 146 aa, Homo sapiens
  ENSP00000368121
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYF

SEQ ID NO: 28350 - protein, 420 aa, Homo sapiens
  ENSP00000441063
MEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKRHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 28351 - protein, 459 aa, Homo sapiens
  ENSP00000418589
MASSASLETMVPPACPRAGASPATSKTLAFSIERIMAKTSEPRAPFEPRPGALEADGSQGKKLLNLCSPLPCMIPLQPLGYEVPSKTLLSYSELWKSSLRAGGGGGGGGGGGGGGGGAPVCGASGLCKTNCGVCCKAELGLAPSALPAGRVIKPQVINQAVGLPASGSLYYFNYLDSTAYPPSELLSGHLFPSGLLNAQAPAALAAHPKLFLLENAKLAGLAADKFPHPAPYPHKERLPAPLEQVLKENSALTAERGGVKGHSKLPGGSADGKPKNFTCEVCGKVFNAHYNLTRHMPVHTGARPFVCKVCGKGFRQASTLCRHKIIHTQEKPHKCNQCGKAFNRSSTLNTHIRIHAGYKPFVCEFCGKGFHQKGNYKNHKLTHSGEKQYKCTICNKAFHQVYNLTFHMHTHNDKKPFTCATCGKGFCRNFDLKKHVRKLHDSVGPAAPSAKDLTRTVQS

SEQ ID NO: 28352 - protein, 459 aa, Homo sapiens; identical to SEQ ID NO: 28351
  ENSP00000283268

SEQ ID NO: 28353 - protein, 459 aa, Homo sapiens; identical to SEQ ID NO: 28351
  ENSP00000418804

SEQ ID NO: 28354 - protein, 725 aa, Homo sapiens
  ENSP00000364631
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEKTPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 28355 - protein, 634 aa, Homo sapiens
  ENSP00000432310
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTEVGAPSSCSPPGGAAEPPDTCSCAPAAPAASAFGVSLGPG

SEQ ID NO: 28356 - protein, 724 aa, Homo sapiens
  ENSP00000413833
MESGRGSSTPPGPIAALGMPDTGPGSSSLGKLQALPVGPRAHCGDPVSLAAAGDGSPDIGPTGELSGSLKIPNRDSGIDSPSSSVAGENFPCEEGLEAGPSPTVLGAHAEMALDSQVPKVTPQEEADSDVGEEPDSENTPQKADKDAGLAQHSGPQKLLHIAQELLHTEETYVKRLHLLDQVFCTRLTDAGIPPEVIMGIFSNISSIHRFHGQFLLPELKTRITEEWDTNPRLGDILQKLAPFLKMYGEYVKNFDRAVGLVSTWTQRSPLFKDVVHSIQKQEVCGNLTLQHHMLEPVQRVPRYELLLKDYLKRLPQDAPDRKDAERSLELISTAANHSNAAIRKVEKMHKLLEVYEQLGGEEDIVNPANELIKEGQIQKLSAKNGTPQDRHLFLFNSMILYCVPKLRLMGQKFSVREKMDISGLQVQDIVKPNTAHTFIITGRKRSLELQTRTEEEKKEWIQIIQATIEKHKQNSETFKAFGGAFSQDEDPSLSPDMPITSTSPVEPVVTTEGSSGAAGLEPRKLSSKTRRDKEKQSCKSCGETFNSITKRRHHCKLCGAVICGKCSEFKAENSRQSRVCRDCFLTQPVAPESTETPTADPQPSLLCGPLRLSESGETWSEVWAAIPMSDPQVLHLQGGSQDGRLPRTIPLPSCKLSVPDPEERLDSGHVWKLQWAKQSWYLSASSAELQQQWLETLSTAAHGDTAQDSPGALQLQVPMGAAAP

SEQ ID NO: 28357 - protein, 725 aa, Homo sapiens; identical to SEQ ID NO: 28354
  ENSP00000336914

SEQ ID NO: 28358 - protein, 903 aa, Homo sapiens
  ENSP00000449273
MSDEGGSNFRRVAIRRKSNPSYLPPGVPRPWSRPASHLGRVGTAAFKGQVPSGATGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28359 - protein, 851 aa, Homo sapiens
  ENSP00000431323
MGGCSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28360 - protein, 207 aa, Homo sapiens
  ENSP00000434356
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKVEHETSS

SEQ ID NO: 28361 - protein, 235 aa, Homo sapiens
  ENSP00000437109
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQKIEWR

SEQ ID NO: 28362 - protein, 40 aa, Homo sapiens
  ENSP00000449614
MEEIKPASASCVSKEKPSKVSDLISRFEGGRRLMSKNFTK

SEQ ID NO: 28363 - protein, 766 aa, Homo sapiens
  ENSP00000394487
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28364 - protein, 235 aa, Homo sapiens; identical to SEQ ID NO: 28361
  ENSP00000379089

SEQ ID NO: 28365 - protein, 673 aa, Homo sapiens
  ENSP00000446695
MAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28366 - protein, 30 aa, Homo sapiens
  ENSP00000462623
MEEIKPASASCVSKEKPSKVSDLISRFEGG

SEQ ID NO: 28367 - protein, 878 aa, Homo sapiens
  ENSP00000433666
MNFKRVKPNIFLLNQSRLIISICEIMSTDQGSSTCPKIALVPPCSTSSTTTLVGENVSEEEAQGINGNRPAKHSAASPKPQVPPKPLHLQNSPSSNIHQTPRHKALPSAKPRMEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 28368 - protein, 65 aa, Homo sapiens
  ENSP00000434062
  MOD_RES (1)..(1): Any amino acid
XAETETKVQERENGESPLELEQLDQHHEMKETNEQKLHKIANELLLTERAYVNRLDLLDQKIEWR

SEQ ID NO: 28369 - protein, 1430 aa, Homo sapiens
  ENSP00000344446
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEDVAALESQPLLGFTVIQVKDENSESKVFQLLHKNMLFYVFKAEDAHSAQKWIEAFQEGTIL

SEQ ID NO: 28370 - protein, 133 aa, Homo sapiens
  ENSP00000448350
  MOD_RES (1)..(1): Any amino acid
XNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVDRSISGRHNIVAVLVSSLL

SEQ ID NO: 28371 - protein, 59 aa, Homo sapiens
  ENSP00000408291
MTSAAVQEHPRRNRMILVLVTFPLMRRKSSTVLMKMMSALSQVKESLTHWKINRMKIME

SEQ ID NO: 28372 - protein, 1374 aa, Homo sapiens
  ENSP00000450342
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKLDHQHSPRIGSPGNHKSPSSALSSVLHSIPSGRKQKKIPAALKEVSANTEDSSMSGYLYRSKGNKKPWKHFWFVIKNKVLYTYAASEVRSEI

SEQ ID NO: 28373 - protein, 279 aa, Homo sapiens
  ENSP00000450240
MLQLRPQVILNCLRRSRPCSLCQDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENKEEVSPLGSKAPIWIPDTRATMCMICTSEFTLTWRRHHCRACGKIVCQACSSNKYGLDYLKNQPARVCEHCFQELQKL

SEQ ID NO: 28374 - protein, 1206 aa, Homo sapiens
  ENSP00000449005
MTSAAEIKKPPVAPKPKFVVANNKPAPPPIAPKPDIVISSVPQSTKKMKPAIAPKPKVLKTSPVREIGQSPSRKIMLNLEGHKQELAESTDNFNCKYEGNQSNDYISPMCSCSSECIHKLGHRENLCVKQLVLEPLEMNENLENSKIDETLTIKTRSKCDLYGEKAKNQGGVVLKASVLEEELKDALIHQMPPFISAQKHRPTDSPEMNGGCNSNGQFRIEFADLSPSPSSFEKVPDHHSCHLQLPSDECEHFETCQDDSEKSNNCFQSSELEALENGKRSTLISSDGVSKKSEVKDLGPLEIHLVPYTPKFPTPKPRKTRTARLLRQKCVDTPSESTEEPGNSDSSSSCLTENSLKINKISVLHQNVLCKQEQVDKMKLGNKSELNMESNSDAQDLVNSQKAMCNETTSFEKMAPSFDKDSNLSSDSTTVDGSSMSLAVDEGTGFIRCTVSMSLPKQLKLTCNEHLQSGRNLGVSAPQMQKESVIKEENSLRIVPKKPQRHSLPATGVLKKAASEELLEKSSYPSSEEKSSEKSLERNHLQHLCAQNRGVSSSFDMPKRASEKPVWKLPHPILPFSGNPEFLKSVTVSSNSEPSTALTKPRAKSLSAMDVEKCTKPCKDSTKKNSFKKLLSMKLSICFMKSDFQKFWSKSSQLGDTTTGHLSSGEQKGIESDWQGLLVGEEKRSKPIKAYSTENYSLESQKKRKKSRGQTSAANGLRAESLDDQMLSRESSSQAPYKSVTSLCAPEYENIRHYEEIPEYENLPFIMAIRKTQELEWQNSSSMEDADANVYEVEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGFAAVVREFEMSPRCANLALKHYLLKPVQRIPQYRLLLTDYLKNLIEDAGDYRDTQDALAVVIEVANHANDTMKQGDNFQKLMQIQYSLNGHHEIVQPGRVFLKEGILMKLSRKVMQPRMFFLFNDALLYTTPVQSGMYKLNNMLSLAGMKVRKPTQEAYQNELKIESVERSFILSASSATERDEWLEAISRAIEEYAKKRITFCPSRSLDEADSENK

SEQ ID NO: 28375 - protein, 245 aa, Homo sapiens
  ENSP00000322390
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 28376 - protein, 192 aa, Homo sapiens
  ENSP00000303391
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 28377 - protein, 226 aa, Homo sapiens
  ENSP00000409276
MLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 28378 - protein, 199 aa, Homo sapiens
  ENSP00000487411
MSGKVTKPKEEKDASKEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 28379 - protein, 255 aa, Homo sapiens
  ENSP00000396198
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 28380 - protein, 206 aa, Homo sapiens
  ENSP00000406916
MRTSMKKVGMHHLSSSGGSYYLILDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKP

SEQ ID NO: 28381 - protein, 98 aa, Homo sapiens
  ENSP00000411999
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGT

SEQ ID NO: 28382 - protein, 43 aa, Homo sapiens
  ENSP00000388688
MLRQDSIQSAELKKKESPFRAKCHEIFCCPLKQVHHKENTEPE

SEQ ID NO: 28383 - protein, 239 aa, Homo sapiens
  ENSP00000334122
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 28384 - protein, 268 aa, Homo sapiens
  ENSP00000311697
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 28385 - protein, 123 aa, Homo sapiens
  ENSP00000398353
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 28386 - protein, 119 aa, Homo sapiens
  ENSP00000423903
NPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASNTLET

SEQ ID NO: 28387 - protein, 258 aa, Homo sapiens
  ENSP00000339067
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 28388 - protein, 820 aa, Homo sapiens
  ENSP00000380280
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28389 - protein, 820 aa, Homo sapiens
  ENSP00000432972
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28390 - protein, 820 aa, Homo sapiens; identical to SEQ ID NO: 28388
  ENSP00000380302

SEQ ID NO: 28391 - protein, 733 aa, Homo sapiens
  ENSP00000348537
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28392 - protein, 812 aa, Homo sapiens
  ENSP00000337247
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28393 - protein, 731 aa, Homo sapiens
  ENSP00000327229
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28394 - protein, 733 aa, Homo sapiens
  ENSP00000380292
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28395 - protein, 134 aa, Homo sapiens
  ENSP00000434800
VSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELPAAGT

SEQ ID NO: 28396 - protein, 820 aa, Homo sapiens; identical to SEQ ID NO: 28388
  ENSP00000380297

SEQ ID NO: 28397 - protein, 61 aa, Homo sapiens
  ENSP00000435254
MWSWKCLLFWAVLVTATLCTARPSPTLPEQACPDLQEAKWCSASFHSITPLPFGLGTRLSD

SEQ ID NO: 28398 - protein, 139 aa, Homo sapiens
  ENSP00000434869
MEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSK

SEQ ID NO: 28399 - protein, 298 aa, Homo sapiens
  ENSP00000434712
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGS

SEQ ID NO: 28400 - protein, 145 aa, Homo sapiens
  ENSP00000433569
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEY

SEQ ID NO: 28401 - protein, 142 aa, Homo sapiens
  ENSP00000435283
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCI

SEQ ID NO: 28402 - protein, 150 aa, Homo sapiens
  ENSP00000433163
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSACPDLQEAKWCSASFHSITPLPFGLGTRLSD

SEQ ID NO: 28403 - protein, 85 aa, Homo sapiens
  ENSP00000434473
MWSWKCLLFWAVLVTATLCTARPSPTLPEQDALPSSEDDDDDDDSSSEEKETDNTKPNPVAPYWTSPEKMEKKLHAVPAAKTVKF

SEQ ID NO: 28404 - protein, 54 aa, Homo sapiens
  ENSP00000392645
MWSWKCLLFWAVLVTATLCTARPSPTLPEQDALPSSEDDDDDDDSSSEEKETDN

SEQ ID NO: 28405 - protein, 106 aa, Homo sapiens
  ENSP00000400708
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSP

SEQ ID NO: 28406 - protein, 1 aa, Homo sapiens
  ENSP00000398318
M

SEQ ID NO: 28407 - protein, 853 aa, Homo sapiens
  ENSP00000393312
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 28408 - protein, 822 aa, Homo sapiens [sequence omitted]

SEQ ID NO: 28409 - protein, 228 aa, Homo sapiens
  ENSP00000484553
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKPWKRGRQ

SEQ ID NO: 28410 - protein, 367 aa, Homo sapiens
  ENSP00000340636
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSVPIDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKDCWS

SEQ ID NO: 28411 - protein, 821 aa, Homo sapiens
  ENSP00000351276
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28412 - protein, 593 aa, Homo sapiens
  ENSP00000474011
MCLNKTKQLFGVAKRLPFWRKERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28413 - protein, 86 aa, Homo sapiens
  ENSP00000491912
  MOD_RES (1)..(1): Any amino acid
XPYPGIPVEELFKLLKEGHRMDKPANCTNELYMMMRDCWHAVPSQRPTFKQLVEDLDRILTLTTNEEYLDLSQPLEPYSPCYPDPR

SEQ ID NO: 28414 - protein, 704 aa, Homo sapiens
  ENSP00000348559
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28415 - protein, 705 aa, Homo sapiens
  ENSP00000358056
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28416 - protein, 251 aa, Homo sapiens
  ENSP00000474109
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQGRRC

SEQ ID NO: 28417 - protein, 707 aa, Homo sapiens
  ENSP00000358055
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28418 - protein, 371 aa, Homo sapiens
  ENSP00000404219
FSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELNTWTSANLSNSIHLVTLTQEVLVLQEMILFFLQTPCLTNHAFLSIHT

SEQ ID NO: 28419 - protein, 819 aa, Homo sapiens
  ENSP00000263451
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28420 - protein, 822 aa, Homo sapiens
  ENSP00000410294
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28421 - protein, 680 aa, Homo sapiens
  ENSP00000353262
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 28422 - protein, 769 aa, Homo sapiens
  ENSP00000358052
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 28423 - protein, 768 aa, Homo sapiens
  ENSP00000358054
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNE

SEQ ID NO: 28424 - protein, 669 aa, Homo sapiens
  ENSP00000337665
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRI

SEQ ID NO: 28425 - protein, 254 aa, Homo sapiens
  ENSP00000352309
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 28426 - protein, 136 aa, Homo sapiens
  ENSP00000481464
  MOD_RES (1)..(1): Any amino acid
XSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKSK

SEQ ID NO: 28427 - protein, 64 aa, Homo sapiens
  ENSP00000484892
MVSWGRFICLVVVTMATLSLARPSFSLVEDTTLEPEDAISSGDDEDDTDGAEDFVSENSNNKSK

SEQ ID NO: 28428 - protein, 144 aa, Homo sapiens
  ENSP00000490905
MVSWGRFICLVVVTMATLSLARPSFSLVEDTTLEPEEPPTKYQISQPEVYVAAPGESLEMPSHPEMMRMTPMVRKILSVRTVTTRVSNCPAPMVPERGAWREVLPVTCLLVDSSAPCCVPRPLPFPAVSTFLTFKPENKPVLLH

SEQ ID NO: 28429 - protein, 707 aa, Homo sapiens
  ENSP00000350166
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 28430 - protein, 732 aa, Homo sapiens
  ENSP00000484154
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28431 - protein, 709 aa, Homo sapiens
  ENSP00000358057
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28432 - protein, 821 aa, Homo sapiens
  ENSP00000309878
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVFAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 28433 - protein, 792 aa, Homo sapiens
  ENSP00000420533
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNLVLWGPALGDLHAGGLPVPRHPCGGALQAAEGGPPHGQARQLHTRPVHDHAGVLACRALPEAHLQAAGGGPGPCPYRDVHRRVPGPVGAFRAVLPGWPGHPQLQLLRGRLRVCPRPAAPGPTQQWGLADVKGHWSPTM

SEQ ID NO: 28434 - protein, 806 aa, Homo sapiens
  ENSP00000260795
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 28435 - protein, 694 aa, Homo sapiens
  ENSP00000231803
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 28436 - protein, 112 aa, Homo sapiens
  ENSP00000427289
NPTPSISWLKNGREFRGEHRIGGIKLRHQQWSLVMESVVPSDRGNYTCVVENKFGSIRQTYTLDVLERSPHRPILQAGLPANQTAVLGSDVEFHCKTAGANTTDKELEVLSL

SEQ ID NO: 28437 - protein, 808 aa, Homo sapiens
  ENSP00000339824
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 28438 - protein, 694 aa, Homo sapiens; identical to SEQ ID NO: 28435
  ENSP00000412903

SEQ ID NO: 28439 - protein, 806 aa, Homo sapiens; identical to SEQ ID NO: 28434
  ENSP00000414914

SEQ ID NO: 28440 - protein, 364 aa, Homo sapiens
  ENSP00000479472
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRADGGR

SEQ ID NO: 28441 - protein, 54 aa, Homo sapiens
  ENSP00000463260
MSGGEQKPERYYVGVDVGTGSVRAALVDQSGVLLAFADQPIKNWEPQFNHHEQS

SEQ ID NO: 28442 - protein, 184 aa, Homo sapiens
  ENSP00000406607
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTA

SEQ ID NO: 28443 - protein, 249 aa, Homo sapiens
  ENSP00000489030
MWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARSPD

SEQ ID NO: 28444 - protein, 575 aa, Homo sapiens
  ENSP00000360262
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMRTTGYLYIPALAALHSPSSLLSPQVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 28445 - protein, 551 aa, Homo sapiens
  ENSP00000305922
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 28446 - protein, 507 aa, Homo sapiens
  ENSP00000403425
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQWGK

SEQ ID NO: 28447 - protein, 514 aa, Homo sapiens
  ENSP00000489446
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGDSHRNVIMWLDHRAVSQVNRINETKHSVLQYVGGVMSVEMQAPKLLWLKENLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQIRKTKHRAIK

SEQ ID NO: 28448 - protein, 153 aa, Homo sapiens
  ENSP00000489549
MIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARSPD

SEQ ID NO: 28449 - protein, 112 aa, Homo sapiens
  ENSP00000489146
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEELERDLLG

SEQ ID NO: 28450 - protein, 463 aa, Homo sapiens
  ENSP00000489417
MSGGEQKPERYYVGVDVGTGSVRAALVDQSGVLLAFADQPIKNWEPQFNHHEQSSEDIWAACCVVTKNLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 28451 - protein, 128 aa, Homo sapiens
  ENSP00000489345
MSGGEQKPERYYVGVDVGTGSVRAALVDQSGVLLAFADQPIKNWEPQFNHHEQSSEDIWAACCVVTKKVVQGIDLNQIRGLGFDATCSLVVLDKQFHPLPVNQEGLSAPWCVSGHIQQRKAGTTVSGK

SEQ ID NO: 28452 - protein, 463 aa, Homo sapiens; identical to SEQ ID NO: 28450
  ENSP00000360256

SEQ ID NO: 28453 - protein, 252 aa, Homo sapiens
  ENSP00000360254
MGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 28454 - protein, 1143 aa, Homo sapiens
  ENSP00000427567
MHVMNCVSLVSDKENGNIATAPGFMIGQTPPPAPPPPPPPPPPSPPCSCSREECPSSPPPPPPPPLPGEPPIPPPPPGLPPTTHMNGYSHLGKKKRMRSFFWKTIPEEQVRGKTNIWTLAARQEHHYQIDTKTIEELFGQQEDTTKSSLPRRGRTLNSSFREAREEITILDAKRSMNIGIFLKQFKKSPRSIVEDIHQGKSEHYGSETLREFLKFLPESEEVKKLKAFSGDVSKLSLADSFLYGLIQVPNYSLRIEAMVLKKEFLPSCSSLYTDITVLRTAIKELMSCEELHSILHLVLQAGNIMNAGGYAGNAVGFKLSSLLKLADTKANKPGMNLLHFVAQEAQKKDTILLNFSEKLHHVQKTARLSLENTEAELHLLFVRTKSLKENIQRDGELCQQMEDFLQFAIEKLRELECWKQELQDEAYTLIDFFCEDKKTMKLDECFQIFRDFCTKFNKAVKDNHDREAQELRQLQRLKEQEQKQRSWATGELGAFGRSSSENDVELLTKKGAEGLLPFLHPRPISPSSPSYRPPNTRRSRLSLGPSADRELLTFLESSTGSPEEPNKFHSLPRSSPRQARPTIACLEPAEVRHQDSSFAHKPQASGGQEEAPNPPSAQAHQLAAAQPENHASAFPRARRQGVSVLRKRYSEPVSLGSAQSPPLSPLALGIKEHELVTGLAQFNLQGSQGMEETSQLTLSDFSPMELESVGHRGPQSLSASSSSLTPMGRDALGSLSPALEDGKAAPDEPGSAALGSVGSSDPENKDPRPLFCISDTTDCSLTLDCSEGTDSRPRGGDPEEGGEGDGSMSSGVGEMGDSQVSSNPTSSPPGEAPAPVSVDSEPSCKGGLPRDKPTKRKDVVAPKRGSLKEASPGASKPGSARRSQGAVAKSVRTLTASENESMRKVMPITKSSRGAGWRRPELSSRGPSQNPPSSTDTVWSRQNSVRRASTGAEEQRLPRGSSGSSSTRPGRDVPLQPRGSFKKPSAKPLRNLPRQKPEENKTCRAHSEGPESPKEEPKTPSVPSVPHELPRVPSFARNTVASSSRSMRTDLPPVAKAPGITRTVSQRQLRVKGDPEDAAPKDSSTLRRASSARAPKKRPESAEGPSANTEAPLKARGAGERASLRRKDSSRTTLGRILNPLRK

SEQ ID NO: 28455 - protein, 1143 aa, Homo sapiens; identical to SEQ ID NO: 28454
  ENSP00000260008

SEQ ID NO: 28456 - protein, 280 aa, Homo sapiens
  ENSP00000362107
MSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 28457 - protein, 210 aa, Homo sapiens
  ENSP00000396390
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFC

SEQ ID NO: 28458 - protein, 284 aa, Homo sapiens
  ENSP00000326022
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFCVDCYNHLYANKCVACSKPISGLTGAKFICFQDSQWHSECFNCGKCSVSLVGKGFLTQNKEIFCQKCGSGMDTDI

SEQ ID NO: 28459 - protein, 284 aa, Homo sapiens; identical to SEQ ID NO: 28458
  ENSP00000442357

SEQ ID NO: 28460 - protein, 1439 aa, Homo sapiens
  ENSP00000257209
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28461 - protein, 1622 aa, Homo sapiens
  ENSP00000466937
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKEEEEEEEQPITEPSSEEEREDDASCQGKDSKVGAASGQSPTGRDAAPKSSALPAVSNASSQGKPLLVGTAGGTTWHSGSSGSEATPSALLSPPASAARPSSATPGSLKVSPTIDKLPYVPHSPFHLFSYDFEDSSLSTKEKEAESQKENSSSDSFSLSTYSASEPYHFRSFSSNRYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDTDEEEEVESGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28462 - protein, 1422 aa, Homo sapiens
  ENSP00000352186
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFRYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28463 - protein, 635 aa, Homo sapiens
  ENSP00000467195
MAMRPRSHPPVGAGTGGGPACVPVAEASTGAWTAEGAAGTRCRASRAPCRPPPVPAPSQLPASSPTKCEICVKNTAILAITLITPQDPHLDPVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28464 - protein, 1200 aa, Homo sapiens
  ENSP00000468163
  MOD_RES (1)..(1): Any amino acid
XFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28465 - protein, 528 aa, Homo sapiens
  ENSP00000467462
RLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 28466 - protein, 375 aa, Homo sapiens
  ENSP00000465843
  MOD_RES (1)..(1): Any amino acid
XAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDDPLVPGLWELMTRPMSQMMQLMRSWTASSSQPPKCPVSEWCRGRGNDPGPTGNLCEEP

SEQ ID NO: 28467 - protein, 211 aa, Homo sapiens
  ENSP00000321962
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 28468 - protein, 29 aa, Homo sapiens
  ENSP00000386768
MISSTSVYATWRQCFPAFFIPEADGGKAL

SEQ ID NO: 28469 - protein, 759 aa, Homo sapiens
  ENSP00000333836
MISSTSVYGLKMQWTPEHAQWPEQHFDITSTTRSPAHKVEAYRGHLQRTYQYAWANDDISALTASNLLKKYAEKYSGILEGPVDRPVLSNYSDTPSGLVNGRKNESEPWQPSLNSEAVYPMNCVPDVITASKAGVSSALPPADVSASIGSSPGVASNLTEPSYSSSTCGSHTVPSLHAGLPSQEYAPGYNGSYLHSTYSSQPAPALPSPHPSPLHSSGLLQPPPPPPPPPALVPGYNGTSNLSSYSYPSASYPPQTAVGSGYSPGGAPPPPSAYLPSGIPAPTPLPPTTVPGYTYQGHGLTPIAPSALTNSSASSLKRKAFYMAGQGDMDSSYGNYSYGQQRSTQSPMYRMPDNSISNTNRGNGFDRSAETSSLAFKPTKQLMSSEQQRKFSSQSSRALTPPSYSTAKNSLGSRSSESFGKYTSPVMSEHGDEHRQLLSHPMQGPGLRAATSSNHSVDEQLKNTDTHLIDLVTNEIITQGPPVDWNDIAGLDLVKAVIKEEVLWPVLRSDAFSGLTALPRSILLFGPRGTGKTLLGRCIASQLGATFFKIAGSGLVAKWLGEAEKIIHASFLVARCRQPSVIFVSDIDMLLSSQVNEEHSPVSRMRTEFLMQLDTVLTSAEDQIVVICATSKPEEIDESLRRYFMKRLLIPLPDSTARHQIIVQLLSQHNYCLNDKEFALLVQRTEGFSGLDVAHLCQEAVVGPLHAMPATDLSAIMPSQLRPVTYQDFENAFCKIQPSISQKELDMYVEWNKMFGCSQ

SEQ ID NO: 28470 - protein, 148 aa, Homo sapiens
  ENSP00000417617
PTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITIKEVCKQRIPARIPKPKSTGITKISTKAPTVPMDKPIYQNGC

SEQ ID NO: 28471 - protein, 1135 aa, Homo sapiens
  ENSP00000346560
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 28472 - protein, 711 aa, Homo sapiens
  ENSP00000417774
MALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 28473 - protein, 895 aa, Homo sapiens
  ENSP00000419642
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVEPLLLPH

SEQ ID NO: 28474 - protein, 1133 aa, Homo sapiens
  ENSP00000327880
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERLKKLIDQEIKSQEEKEQEKEKRVTTLKEELTKLKSFALMVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 28475 - protein, 837 aa, Homo sapiens
  ENSP00000419874
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASP

SEQ ID NO: 28476 - protein, 255 aa, Homo sapiens
  ENSP00000381371
MRSRGSDTEGSAQKKFPRHTKGHSFQGPKNMKHRQQDKDSPSESDVILPCPKAEKPHSGNGHQAEDLSRDDLLFLLSILEGELQARDEVIGILKAEKMDLALLEAQYGFVTPKKVLEALQRDAFQAKSTPWQEDIYEKPMNELDKVVEKHKESYRRILGQLLVAEKSRRQTILELEEEKRKHKEYMEKSDEFICLLEQECERWSLALLPRLECNGMILAHCNLCLLGSSDSPASAFQVAGITGTRHHAQLVFVFL

SEQ ID NO: 28477 - protein, 893 aa, Homo sapiens
  ENSP00000373192
MVVDEQQRLTAQLTLQRQKIQELTTNAKETHTKLALAEARVQEEEQKATRLEKELQTQTTKFHQDQDTIMAKLTNEDSQNRQLQQKLAALSRQIDELEETNRSLRKAEEELQDIKEKISKGEYGNAGIMAEVEELRKRVLDMEGKDEELIKMEEQCRDLNKRLERETLQSKDFKLEVEKLSKRIMALEKLEDAFNKSKQECYSLKCNLEKERMTTKQLSQELESLKVRIKELEAIESRLEKTEFTLKEDLTKLKTLTVMFVDERKTMSEKLKKTEDKLQAASSQLQVEQNKVTTVTEKLIEETKRALKSKTDVEEKMYSVTKERDDLKNKLKAEEEKGNDLLSRVNMLKNRLQSLEAIEKDFLKNKLNQDSGKSTTALHQENNKIKELSQEVERLKLKLKDMKAIEDDLMKTEDEYETLERRYANERDKAQFLSKELEHVKMELAKYKLAEKTETSHEQWLFKRLQEEEAKSGHLSREVDALKEKIHEYMATEDLICHLQGDHSVLQKKLNQQENRNRDLGREIENLTKELERYRHFSKSLRPSLNGRRISDPQVFSKEVQTEAVDNEPPDYKSLIPLERAVINGQLYEESENQDEDPNDEGSVLSFKCSQSTPCPVNRKLWIPWMKSKEGHLQNGKMQTKPNANFVQPGDLVLSHTPGQPLHIKVTPDHVQNTATLEITSPTTESPHSYTSTAVIPNCGTPKQRITILQNASITPVKSKTSTEDLMNLEQGMSPITMATFARAQTPESCGSLTPERTMSPIQVLAVTGSASSPEQGRSPEPTEISAKHAIFRVSPDRQSSWQFQRSNSNSSSVITTEDNKIHIHLGSPYMQAVASPVRPASPSAPLQDNRTQGLINGALNKTTNKVTSSITITPTATPLPRQSQITVSNIYN

SEQ ID NO: 28478 - protein, 437 aa, Homo sapiens
  ENSP00000400223
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 28479 - protein, 459 aa, Homo sapiens
  ENSP00000001008
MTAEEMKATESGAQSAPLPMEGVDISPKQDEGVLKVIKREGTGTEMPMIGDRVFVHYTGWLLDGTKFDSSLDRKDKFSFDLGKGEVIKAWDIAIATMKVGEVCHITCKPEYAYGSAGSPPKIPPNATLVFEVELFEFKGEDLTEEEDGGIIRRIQTRGEGYAKPNEGAIVEVALEGYYKDKLFDQRELRFEIGEGENLDLPYGLERAIQRMEKGEHSIVYLKPSYAFGSVGKEKFQIPPNAELKYELHLKSFEKAKESWEMNSEEKLEQSTIVKERGTVYFKEGKYKQALLQYKKIVSWLEYESSFSNEEAQKAQALRLASHLNLAMCHLKLQAFSAAIESCNKALELDSNNEKGLFRRGEAHLAVNDFELARADFQKVLQLYPNNKAAKTQLAVCQQRIRRQLAREKKLYANMFERLAEEENKAKAEASSGDHPTDTEMKEEQKSNTAGSQSQVETEA

SEQ ID NO: 28480 - protein, 51 aa, Homo sapiens
  ENSP00000439703
MTAEEMKATESGAQSAPLPMEGVDISPKQDEGVLKIIGDLKRLLQRLSCGM

SEQ ID NO: 28481 - protein, 86 aa, Homo sapiens
  ENSP00000446368
MPMIGDRVFVHYTGWLLDGTKFDSSLDRKDKFSFDLGKGEVIKAWDIAIATMKVGEVCHITCKPEYAYGSAGSPPKIPPNATLVFE

SEQ ID NO: 28482 - protein, 84 aa, Homo sapiens
  ENSP00000438491
  MOD_RES (1)..(1): Any amino acid
XVNDFELARADFQKVLQLYPNNKAAKTQLAVCQQRIRRQLAREKKLYANMFERLAEEENKAPWLTPAIPALCRAKVGGSLEPSR

SEQ ID NO: 28483 - protein, 23 aa, Homo sapiens
  ENSP00000442193
  MOD_RES (1)..(1): Any amino acid
XKEEQKSNTAGSQSQIRKPRLRS

SEQ ID NO: 28484 - protein, 51 aa, Homo sapiens; identical to SEQ ID NO: 28480
  ENSP00000486800

SEQ ID NO: 28485 - protein, 457 aa, Homo sapiens
  ENSP00000349811
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRYGFGEAGKPKFGIEPNAELIYEVTLKSFEKAKESWEMDTKEKLEQAAIVKEKGTVYFKGGKYMQAVIQYGKIVSWLEMEYGLSEKESKASESFLLAAFLNLAMCYLKLREYTKAVECCDKALGLDSANEKGLYRRGEAQLLMNEFESAKGDFEKVLEVNPQNKAARLQISMCQKKAKEHNERDRRIYANMFKKFAEQDAKEEANKAMGKKTSEGVTNEKGTDSQAMEEEKPEGHV

SEQ ID NO: 28486 - protein, 457 aa, Homo sapiens; identical to SEQ ID NO: 28485
  ENSP00000444810

SEQ ID NO: 28487 - protein, 457 aa, Homo sapiens; identical to SEQ ID NO: 28485
  ENSP00000441205

SEQ ID NO: 28488 - protein, 268 aa, Homo sapiens
  ENSP00000442340
MTTDEGAKNNEESPTATVAEQGEDITSKKDRGVLKIVKRVGNGEETPMIGDKVYVHYKGKLSNGKKFDSSHDRNEPFVFSLGKGQVIKAWDIGVATMKKGEICHLLCKPEYAYGSAGSLPKIPSNATLFFEIELLDFKGEDLFEDGGIIRRTKRKGEGYSNPNEGATVEIHLEGRCGGRMFDCRDVAFTVGEGEDHDIPIGIDKALEKMQREEQCILYLGPRPKNPGRWIPKKNWSRLPLSKRREPYTSRCVSPYAILSISKNLFKCW

SEQ ID NO: 28489 - protein, 49 aa, Homo sapiens
  ENSP00000477262
MTASGSPDYGQPHKINPLPPQQEWINQPVRVNVKREYDHMNGSRFTAGL

SEQ ID NO: 28490 - protein, 106 aa, Homo sapiens
  ENSP00000476428
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVR

SEQ ID NO: 28491 - protein, 452 aa, Homo sapiens
  ENSP00000433488
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 28492 - protein, 82 aa, Homo sapiens
  ENSP00000399985
MDGTIKEALSVVSDDQSLFDSAYGAAAHLPKADMTASGSPDYGQPHKINPLPPQQEWINQPVRVNVKREYDHMNGSRRQLPH

SEQ ID NO: 28493 - protein, 419 aa, Homo sapiens
  ENSP00000432950
MTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 28494 - protein, 259 aa, Homo sapiens
  ENSP00000339627
MDPGSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 28495 - protein, 386 aa, Homo sapiens
  ENSP00000281428
MEGGLAGERARESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 28496 - protein, 2633 aa, Homo sapiens
  ENSP00000420213
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADDTDSQSWRSPLKALSEFFKGDPKGDFNKTGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 28497 - protein, 2602 aa, Homo sapiens
  ENSP00000295956
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 28498 - protein, 2578 aa, Homo sapiens
  ENSP00000351339
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 28499 - protein, 2591 aa, Homo sapiens
  ENSP00000415599
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 28500 - protein, 2409 aa, Homo sapiens
  ENSP00000418510
MQEHSTRRRSLSLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 28501 - protein, 135 aa, Homo sapiens
  ENSP00000420199
  MOD_RES (1)..(1): Any amino acid
XLAVEGPSKVDIQTEDLEDGTCKVSYFPTVPGVYIVSTKFADEHVPEINSSDMSAHVTSPSGRVTEAEIVPMGKNSHCVRFVPQEMGVHTVSVKYRGQHVTGSPFQFTVGPLGEGGAHKVRAGGPGLERGEAGVP

SEQ ID NO: 28502 - protein, 72 aa, Homo sapiens
  ENSP00000419954
FADEHVPGSPFTVKISGEGRVKESITRTSRAPSVATVGSICDLNLKIPGVRVMNCSAQILWGWRVQFHTGSR

SEQ ID NO: 28503 - protein, 195 aa, Homo sapiens
  ENSP00000414532
MYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGRNTSLAALFMSQCLKTVFSNPGESSCGCFCCLFVIHFIQSPPACLWG

SEQ ID NO: 28504 - protein, 660 aa, Homo sapiens
  ENSP00000332879
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 28505 - protein, 660 aa, Homo sapiens; identical to SEQ ID NO: 28504
  ENSP00000451050

SEQ ID NO: 28506 - protein, 993 aa, Homo sapiens
  ENSP00000241453
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 28507 - protein, 739 aa, Homo sapiens
  ENSP00000370374
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSKKK

SEQ ID NO: 28508 - protein, 1100 aa, Homo sapiens
  ENSP00000329219
MGNAAGSAEQPAGPAAPPPKQPAPPKQPMPAAGELEERFNRALNCMNLPPDKVQLLSQYDNEKKWELICDQERFQVKNPPAAYIQKLKSYVDTGGVSRKVAADWMSNLGFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKLTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITVIKTVPFTARTGKRTSRLLCEASLGEEMPL

SEQ ID NO: 28509 - protein, 682 aa, Homo sapiens
  ENSP00000465474
MAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITDLRNQPYIRADTGRRSARRRPPGPPLQVTSDLSL

SEQ ID NO: 28510 - protein, 488 aa, Homo sapiens
  ENSP00000465137
ELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFSTPLHLPHPHSVIKTVPFTARTGKRTSRLLCEASLGEEMPL

SEQ ID NO: 28511 - protein, 127 aa, Homo sapiens
  ENSP00000466711
VRQDDCMVLKEFLRANSPTMDKLLADSKTAQKAEQEVEQWKKEAAAQEAGADTPGKGEPPAPKVGNCSWAWYWAAGMHGISSPSGATPTPSLLQTDPAPGAWDGKGFFLLKPAVLAVGDQADIPGFW

SEQ ID NO: 28512 - protein, 151 aa, Homo sapiens
  ENSP00000468301
  MOD_RES (1)..(1): Any amino acid
XRQDDCMVLKEFLRANSPTMDKLLADSKTAQKAEQEVEQWKKEAAAQEAGADTPGKGEPPAPKSPPKARRPQMDLISELKRRQQKEPLIYESDRDGAIEDIITGKGLARPWSYPQSVLLCFLLTQCAILWGTGCHTASCYLFCFSFLFPFS

SEQ ID NO: 28513 - protein, 626 aa, Homo sapiens
  ENSP00000327442
MGNAAGSAEQPAGPAAPPPKQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQAVPTGGL

SEQ ID NO: 28514 - protein, 1027 aa, Homo sapiens
  ENSP00000335655
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 28515 - protein, 1027 aa, Homo sapiens
  ENSP00000447479
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITVLKSVPFTARTAKRGSRFFCDAAHHDESNC

SEQ ID NO: 28516 - protein, 976 aa, Homo sapiens
  ENSP00000344311
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKEAEQENEARKKQEEVMREKQLAQEAKKLDAKTPSQRNKWQQQELIAELRRRQAKEHRPVYEGKDGTIEDIITGLHCQPMVVRHQARSAAPPSGPPRAPGPH

SEQ ID NO: 28517 - protein, 55 aa, Homo sapiens
  ENSP00000448939
MLRRVREGIGKSSMNLPPDKARLLRQYDNEKKWDLICDQERFQVKNPPHTYIQKL

SEQ ID NO: 28518 - protein, 532 aa, Homo sapiens
  ENSP00000356729
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 28519 - protein, 48 aa, Homo sapiens
  ENSP00000476963
MGKKVAIIGAGVSGLASIRSCLEEGLEPTCFEKSNDIGGLWKFSRSHE

SEQ ID NO: 28520 - protein, 218 aa, Homo sapiens
  ENSP00000477451
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPDYKEPGVFNGKRVLVVGLGNSGCDIATELSRTAEQVMISSRSGSWVMSRVWDNGYPWDMLLV

SEQ ID NO: 28521 - protein, 71 aa, Homo sapiens
  ENSP00000408496
MYVTMMMTDQIPLELPPLLNGEVAMMPHLVNGDAAQQVILVQVNPGETFTIRAEDGTLQCIQDEVVKRACD

SEQ ID NO: 28522 - protein, 1204 aa, Homo sapiens
  ENSP00000411242
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 28523 - protein, 1204 aa, Homo sapiens; identical to SEQ ID NO: 28522
  ENSP00000338523

SEQ ID NO: 28524 - protein, 71 aa, Homo sapiens; identical to SEQ ID NO: 28521
  ENSP00000392471

SEQ ID NO: 28525 - protein, 1204 aa, Homo sapiens; identical to SEQ ID NO: 28522
  ENSP00000389094

SEQ ID NO: 28526 - protein, 208 aa, Homo sapiens
  ENSP00000389064
MFTKEKIWSEVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGG

SEQ ID NO: 28527 - protein, 750 aa, Homo sapiens
  ENSP00000256999
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 28528 - protein, 719 aa, Homo sapiens
  ENSP00000349129
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 28529 - protein, 74 aa, Homo sapiens
  ENSP00000434928
MWNLLHETDSAVATARRPRWLCAGALVLAGGFFLLGFLFGWFIKSSNEATNITPKHNMKAFLDELKAENIKKFL

SEQ ID NO: 28530 - protein, 735 aa, Homo sapiens
  ENSP00000344131
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 28531 - protein, 704 aa, Homo sapiens
  ENSP00000431463
MTAGSSYPLFLAAYACTGCLAERLGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSKHVIYAPSSHNKYAGESFPGIYDALFDIESKVDPSKAWGEVKRQIYVAAFTVQAAAETLSEVA

SEQ ID NO: 28532 - protein, 46 aa, Homo sapiens
  ENSP00000436569
MWNLLHETDSAVATARRPRWLCAGALVLAGGFFLLGFLFVKVGKRN

SEQ ID NO: 28533 - protein, 64 aa, Homo sapiens
  ENSP00000431577
MKAFLDELKAENIKKFLYNFTQIPHLAGTEQNFQLAKQIQSQWKEFGLDSVELAHYDVLLSYPN

SEQ ID NO: 28534 - protein, 48 aa, Homo sapiens
  ENSP00000431263
MWNLLHETDSAVATARRPRWLCAGALVLAGGFFLLGFLFVTEASLGTV

SEQ ID NO: 28535 - protein, 442 aa, Homo sapiens
  ENSP00000344086
MGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 28536 - protein, 263 aa, Homo sapiens
  ENSP00000467497
MFQAFPGDYDSGSRCSSSPSAESQYLSSVDSFGSPPTAAASQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28537 - protein, 302 aa, Homo sapiens
  ENSP00000407207
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28538 - protein, 338 aa, Homo sapiens
  ENSP00000245919
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28539 - protein, 299 aa, Homo sapiens
  ENSP00000466530
MFQAFPGDYDSGSRCSSSPSAESQYLSSVDSFGSPPTAAASQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28540 - protein, 195 aa, Homo sapiens
  ENSP00000414177
MFQAFPGDYDSGSRCSSSPSAESQYLSSVDSFGSPPTAAASQETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28541 - protein, 177 aa, Homo sapiens
  ENSP00000465068
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETVSKGHQNLAWVGGSKRGRKFLMNGGGLH

SEQ ID NO: 28542 - protein, 237 aa, Homo sapiens
  ENSP00000465552
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 28543 - protein, 188 aa, Homo sapiens
  ENSP00000468482
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 28544 - protein, 289 aa, Homo sapiens
  ENSP00000468207
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 28545 - protein, 137 aa, Homo sapiens
  ENSP00000465528
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAE

SEQ ID NO: 28546 - protein, 291 aa, Homo sapiens
  ENSP00000485018
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEEVQVLGDPFPVVNPSYTSSFVLTCPEVSAFAGAQRTSGSDQPSDPLNSPSLLAL

SEQ ID NO: 28547 - protein, 318 aa, Homo sapiens
  ENSP00000368939
MVQGWRIKSKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAIGPWQVAVPHIPLFPWQETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 28548 - protein, 326 aa, Homo sapiens
  ENSP00000264716
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 28549 - protein, 202 aa, Homo sapiens
  ENSP00000396497
MPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKA

SEQ ID NO: 28550 - protein, 472 aa, Homo sapiens
  ENSP00000250448
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 28551 - protein, 36 aa, Homo sapiens
  ENSP00000451704
MLGTVKMEGHETSDWNSYYADTQELAITLQKFNYHY

SEQ ID NO: 28552 - protein, 463 aa, Homo sapiens
  ENSP00000400341
MHSASSMLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 28553 - protein, 457 aa, Homo sapiens
  ENSP00000366319
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 28554 - protein, 489 aa, Homo sapiens [sequence omitted]

SEQ ID NO: 28555 - protein, 365 aa, Homo sapiens
  ENSP00000366534
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 28556 - protein, 667 aa, Homo sapiens
  ENSP00000362154
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 28557 - protein, 668 aa, Homo sapiens
  ENSP00000386958
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 28558 - protein, 678 aa, Homo sapiens
  ENSP00000362148
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 28559 - protein, 680 aa, Homo sapiens
  ENSP00000309823
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 28560 - protein, 87 aa, Homo sapiens
  ENSP00000393704
MEGELGPALSRGEAYGHHTSSYQLLGNAQKLPFPPWPDTALQVARQFLLQQASGLSSPGNNDSKQSASAVQVPVSVAMMSPQMLTPQ

SEQ ID NO: 28561 - protein, 680 aa, Homo sapiens; identical to SEQ ID NO: 28559
  ENSP00000362151

SEQ ID NO: 28562 - protein, 1976 aa, Homo sapiens
  ENSP00000326330
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 28563 - protein, 4012 aa, Homo sapiens
  ENSP00000422834
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGHVEYSHGTGEPGGSFAFKFDVVDGEGNRLIDKSFSISILEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 28564 - protein, 39 aa, Homo sapiens
  ENSP00000425583
MGVLKVWLGLALALAEFAVLPHHSEGACVYQDSLLAEGG

SEQ ID NO: 28565 - protein, 666 aa, Homo sapiens
  ENSP00000423645
  MOD_RES (1)..(1): Any amino acid
XGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEGQNLDFCQNLEVISAVCLGISSTEN

SEQ ID NO: 28566 - protein, 652 aa, Homo sapiens
  ENSP00000423809
  MOD_RES (1)..(1): Any amino acid
XCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCAGE

SEQ ID NO: 28567 - protein, 426 aa, Homo sapiens
  ENSP00000422221
  MOD_RES (1)..(1): Any amino acid
XTLPLHPNQGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 28568 - protein, 715 aa, Homo sapiens
  ENSP00000370278
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 28569 - protein, 1335 aa, Homo sapiens
  ENSP00000370257
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKECQLRCGI

SEQ ID NO: 28570 - protein, 222 aa, Homo sapiens
  ENSP00000412597
MLDESLAVRRSKKCKEMIMHWEKKEDIDIVNTVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGSSILCL

SEQ ID NO: 28571 - protein, 2179 aa, Homo sapiens
  ENSP00000370262
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 28572 - protein, 2179 aa, Homo sapiens; identical to SEQ ID NO: 28571
  ENSP00000412940

SEQ ID NO: 28573 - protein, 549 aa, Homo sapiens
  ENSP00000283309
MAVPPRGRGIDPARTNPDTFPPSGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 28574 - protein, 481 aa, Homo sapiens
  ENSP00000414115
MDDVKATGRELFQQVCNVASIRDAQFFGLCVVRNNEYIFMDLEQKLSKYFSKDWKKERNEGNEKPRAPFVAFLRVQHYVENGRVISDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAPPQEFVV

SEQ ID NO: 28575 - protein, 180 aa, Homo sapiens
  ENSP00000427668
SRPEEERVGPRRTPGLSHEEIWAVVSSSSRPLPVHCPALTSRTWQASLFHHEQASREDKTFRGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNELLRPEGLSAGGLW

SEQ ID NO: 28576 - protein, 180 aa, Homo sapiens; identical to SEQ ID NO: 28575
  ENSP00000423552

SEQ ID NO: 28577 - protein, 195 aa, Homo sapiens
  ENSP00000424439
METSRPEEERVGPRRTPGLSHEEIWAVVSSSSRPLPVHCPALTSRTWQASLFHHEQASREDKTFRGARCMEPSPERPACSQQEPTLGMDAMASEHRDVLVLLPSREQLRLAVGVKATGRELFQQVCNVASIRDAQFFGLCVVRNNEYIFMDLEQKLSKYFSKDWKKERNEGNEKPRAPFVAFLRVQHYVENGRVI

SEQ ID NO: 28578 - protein, 213 aa, Homo sapiens
  ENSP00000328615
MQAEETKGIGITSMAKCLVKIQTRRSLQLHMVNHCNSNVFVRLLRLGSKVTARNTGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 28579 - protein, 362 aa, Homo sapiens
  ENSP00000365617
MVFRRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 28580 - protein, 556 aa, Homo sapiens
  ENSP00000365621
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESVSMQ

SEQ ID NO: 28581 - protein, 597 aa, Homo sapiens
  ENSP00000303508
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 28582 - protein, 140 aa, Homo sapiens
  ENSP00000412719
GTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRCVQKKICSCFGVTW

SEQ ID NO: 28583 - protein, 553 aa, Homo sapiens
  ENSP00000484839
MQLSKRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 28584 - protein, 1039 aa, Homo sapiens
  ENSP00000350032
MAVQLVPDSALGLLMMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 28585 - protein, 229 aa, Homo sapiens
  ENSP00000488764
  MOD_RES (1)..(1): Any amino acid
XHSQSQPSSQYRIKEYPLYIEGGATPVVVRSLESDQEGHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGSYNDSCFLDSSLYPELADVQWYGQEKAKPGTLV

SEQ ID NO: 28586 - protein, 525 aa, Homo sapiens
  ENSP00000264546
MAAGLLGSEDPPWSWNLTCRALRTCQVRNIRVLQLLLKPWCISRAVYQMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKL

SEQ ID NO: 28587 - protein, 77 aa, Homo sapiens
  ENSP00000487974
MAISQHQFYLDRKQSKSKIHAARSLSEIAIDLTETGTLKTSKLANMGSKGKIISGSSGSLLSSGSGARRHCILLPGS

SEQ ID NO: 28588 - protein, 35 aa, Homo sapiens
  ENSP00000488325
MAISQHQFYLDRKQSKSKIHAARSLSEIAIDLTET

SEQ ID NO: 28589 - protein, 141 aa, Homo sapiens
  ENSP00000492091
MVVQAAVAPNRSQRLLLKIPYGSLRRRSVERMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSC

SEQ ID NO: 28590 - protein, 53 aa, Homo sapiens
  ENSP00000474863
MAVQLVPDSALGLLMMESHCVVQAGGQWCHLGSLQSPISASRVQAILLLHPPE

SEQ ID NO: 28591 - protein, 72 aa, Homo sapiens
  ENSP00000473870
MAVQLVPDSALGLLMDRATHMTTEGGTWREDTFWWWRWPFRLLKSCLSHLCKNLRQRKKILLCSPTREEASD

SEQ ID NO: 28592 - protein, 1034 aa, Homo sapiens
  ENSP00000381549
MASVFMCGVEDLLFSGSRFVWNLTVSTLRRWYTERLRACHQVLRTWCGLQDVYQMTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 28593 - protein, 686 aa, Homo sapiens
  ENSP00000418682
MAISQHQFYLDRKQSKAKIPSARSLDEIAMDLTETGTQRASKLVTLETKSQFIMASNGSLISSGSQDSEVSEEQKREKILELKKKEKLLQEKLLKKVEELKKICLREAELTGKMPKEYPLNIGEKPPQVRRRVGTAFKLDDNLLPSEEDPALQELESNFLIQQKLVEAAKKLANEPDLCKTVKKKRKQDYTDAMKKLQEIENAINEYRIRCGKKPSQKATVLPEDIIPSESSSLSDTTTYDDPSDAFTFPGQRSSSVPHSPRILPPKSLGIERIHFRKSSINEQFVDTRQSREMLSTHSSPYKTLERRPQGGRSMPTTPVLTRNAYSSSHLEPESSSQHCRQRSGSLESQSHLLSEMDSDKPFFSLSKSQRSSSTEILDDGSSYTSQSSTEYYCVTPVTGPYYTTQTLDTRTRGRRRSKKQNVSTSNSGSMPNLAQKDSLRNGVYSKSQEPPSSSYYIAGYTPYAECDFYYSGGYVYENDTEGQYSVNPSYRSSAHYGYERQRDYSRSFHEDEVDRVPHNPYATLRLPRKAAAKSEHITKNIHKALVAEHLRGWYQRASGQKDQGHSPQTSFDSDRGSQRCLGFAGLQVPCSPSSRASSYSSVSSTNASGNWRTQLTIGLSDYETPAHSSYTSCYGNVYNPLPSPSRQYTEISQLDGTDGNQLEDNLESSEQRLFWHEDSKPGTLV

SEQ ID NO: 28594 - protein, 161 aa, Homo sapiens
  ENSP00000419869
MSRLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLETKSQFIMASNGSLISSGSQDSEVSEEQKREKILELKKKEKLLQEKLLKKVEELKK

SEQ ID NO: 28595 - protein, 17 aa, Homo sapiens
  ENSP00000420735
MAISQHQFYLDRKQSKV

SEQ ID NO: 28596 - protein, 183 aa, Homo sapiens
  ENSP00000418962
RNANGRSPNNSDKTFLSKFSSQEITLVKPRFYIESISFLKDKTTVELFFLNAKACVHKGQIEVESETIFKLAAFILQEAKGDYTSDENARKDLKTLPAFPTKTLQEHPSLAYCEDRVIEHYLKIKGLTRGQAVVQYMKIVEALPTYGVHYYAVKDKQGLPWWLGISYKGIGQYDIQDKVKPRK

SEQ ID NO: 28597 - protein, 167 aa, Homo sapiens
  ENSP00000418373
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDENARKDLKTLPAFPTKTLQEHPSLAY

SEQ ID NO: 28598 - protein, 142 aa, Homo sapiens
  ENSP00000418023
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHKGQIEVESETIFKLAAFILQEAKGDYTSDE

SEQ ID NO: 28599 - protein, 113 aa, Homo sapiens
  ENSP00000417550
MTEGRHCQVHLLDDRRLELLVQPKLLARELLDLVASHFNLKEKEYFGITFIDDTGQQNWLQLDHRVLDHDLPKKPGPTILHFAVRFYIESISFLKDKTTVELFFLNAKACVHK

SEQ ID NO: 28600 - protein, 80 aa, Homo sapiens
  ENSP00000417765
MTEGRHCQVHLLDDRRLELLVQPKLLARELLDLVASHFNLKEKEYFGITFIDDTPICLHFMQPDTLSEESFHFLQIISKE

SEQ ID NO: 28601 - protein, 1578 aa, Homo sapiens
  ENSP00000366995
MEELETSLFQTRKAHRIEQMVARWLRRSRDSSARAKVAAADGPARNPTQTLIPVRHTVKIDKDTLLQDYGFHISESLPLTVVAVTAGGSAHGKLFPGDQILQMNNEPAEDLSWERAVDILREAEDSLSITVVRCTSGVPKSSFLTEEKRARLKTNPVKVHFAEEVLISGHSQGNSLLCMPNVLKLYLENGQTKAFKFEANTTVKDIILTVKEKLSIRSIEYFALALEEQYSISRLHLLHEEELIQQVVEREESHDYRCLFRVCFVPKDPLDLLKEDPVAFEYLYLQSCSDVLQERFAVEMKCSSALRLAALHIQERIYACAQPQKISLKYIEKDWGIENFISPTLLRNMKGKDIKKAISFHMKRNQNLLEPRQKQLISAAQLRLNYLQILGELKTYGGRIFNATLMLQDRESYIALLVGAKYGISQVINSKLNIMSTLAEFANISRVELTEESEKVSVVKVYLQDVKVLTLLLESNSAKDLACLIAGYYRLLVDPVTSIFLWPGNKQQAHRVSAEEGYESRACSDSEESSEVDCVLEPLSDRRLVKLAPCRSLIKEEQPPGNSPTPEVARRGPSTCGASSTTDSAESEASDSANTESRGYRTSGSSESMDALEEDDLDTCSSSRSTFFHFGSPGLAESIDSDSQEERSGIETSGFLCLLDLAQRANPQCQKTEFSESAALETFGWAPELSTVRLDPRLYEGSHADYYSLCSSVSPASYLSDSSESTASRQGGAPPAWGQQGWTEAQPSSMLEPLALHPPLAFEDGSSDEEYYDAADKLTPPGPPSGPRDVSTAEPSATSLQNKASTSSPENSLPCGPDGRQPSRRGGVKKYAKTLRKRRSFLQTDYTSQVSFPLVPSASLESVDDVCYYDREPYLALGAPSPTVSSLQDMQGEPGLLETKALGLLAPLRETKSTNPASRVMEMEPETMETKSVIDSRVSSISAIRFRIDPNNKENSGVVPAASSSASTPHCSNPGSSGPDTAQARPSQILPLSQDLDGIAPKEPTIEHGDSSFSLSSGDPNPDRACLASNPGLNNVSQGDTLELQLEPHVQLEMGLESFCTNHIQETAPKYTEPLLSPRDEPRSDECGINPGEKIASIPTKEEPQGQLSLERDREVTNKNGTNVFQEESRKDSGDSPGDVSNNVSQTLDISSPAGKIVTSLSLDAPVTGTEQIPPHPPRDPQGQSREPPGQGCQAQEQKLFVELDLDPDFFLGKQTVSPAVPPEGIKAEAPNHVTGQDIAPRDSPEWVCFNPEPSLPEPLPCPQEDPHLETSNHCLLSEGKSDSSSICLSAEKSFLCFAPESHPEVSASLRVATSLGFAGMNEMVAPRIGMDQCSCQFSYATCFRGPQPETEEEDRDLEAHPMAPLTSPPSAGSPVVLPWRPARAHSCTTAPLSRKSHIWPEYCSRALRQLKATPASTPEGFIQLMESLLELQDILETSWGVGNKHPPEKCTWHFTESRSRLCMGSQKLLSSCRHVIRMDQSPEEMQGAVRDTFQHLVQLAGLCFQFTDCSRCSARHREAAGNLRDVVYTYHQFIEAAKSTCERGYHDLSVKLLARQCTALTAAVFCLTQKFRASTAL

SEQ ID NO: 28602 - protein, 1578 aa, Homo sapiens; identical to SEQ ID NO: 28601
  ENSP00000444411

SEQ ID NO: 28603 - protein, 62 aa, Homo sapiens
  ENSP00000439868
MEELETSLFQTRKAHRIEQMVARWLRRSRDSSARAKVAAADGPARNPTQTLIPVRHTVKIDK

SEQ ID NO: 28604 - protein, 66 aa, Homo sapiens
  ENSP00000490362
MQPLTKDAGMSLSSVTLASALQVRGEALSEEEIWSLLFLAAEQLLEDLRNAPAALRAPALHPADHV

SEQ ID NO: 28605 - protein, 1397 aa, Homo sapiens
  ENSP00000490201
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGSPELDGEDGEGDMYHPCGAPSPTSEDEEYLTINSTCQGQLPCEECLEADSGTIPLPQFCSWGTVPESLPPEESPESGSEWEDLEEPVALEYGALRSLSFGGLNV

SEQ ID NO: 28606 - protein, 1309 aa, Homo sapiens
  ENSP00000363317
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 28607 - protein, 1284 aa, Homo sapiens
  ENSP00000307079
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 28608 - protein, 1322 aa, Homo sapiens
  ENSP00000370057
MDVFSFVKIAKLSSHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSAAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTV

SEQ ID NO: 28609 - protein, 467 aa, Homo sapiens
  ENSP00000492353
  MOD_RES (1)..(1): Any amino acid
XAINTEPLFGTLRDGCHRLPKIKETTALTEPGKERRGGMPSAWSQHPEADPILLPSNIHSESKVPIPNQDPNDFSQANQAYGEAVSWRPPDLRGGSLRTPPSQKALRHSSSILSGSVDLETFRERTKGAVSLKCPGITEAQEASSERRAELPLGRKLTKSFSQSSMHLSSEGRFHKRSPVAHKDSKLYRTLPLRKLEGSNWRCRGPFSYCFLNRGQDEDGEEEEERGEATVQVSCLYRPQMTQAMPEPSSPCLAVAIQKQRGELSRGSVLKVWAEDLRDPDDLDFSNLAFDARIARINALKESTYAMPDGFLAAQNDANELLCLVRATKEKREESRPEAYDLTLSQYKQLLSIESRQLGSACRKMAMAEKSPEEMLLAMTSSFQVLCCLTEACMRLVKVVNSETQRQEIVGKIDEVVINYICLLKAAEAATGKNPGDPNVGLSARHSTTMAALVSTLTRSLKRLLNK

SEQ ID NO: 28610 - protein, 1282 aa, Homo sapiens [sequence omitted]

SEQ ID NO: 28611 - protein, 626 aa, Homo sapiens
  ENSP00000287474
MAVSGFTLGTCILLLHISYVANYPNGKVTQSCHGMIPEHGHSPQSVPVHDIYVSQMTFRPGDQIEVTLSGHPFKGFLLEARNAEDLNGPPIGSFTLIDSEVSQLLTCEDIQGSAVSHRSASKKTEIKVYWNAPSSAPNHTQFLVTVVEKYKIYWVKIPGPIISQPNAFPFTTPKATVVPLPTLPPVSHLTKPFSASDCGNKKFCIRSPLNCDPEKEASCVFLSFTRDDQSVMVEMSGPSKGYLSFALSHDQWMGDDDAYLCIHEDQTVYIQPSHLTGRSHPVMDSRDTLEDMAWRLADGVMQCSFRRNITLPGVKNRFDLNTSYYIFLADGAANDGRIYKHSQQPLITYEKYDVTDSPKNIGGSHSVLLLKVHGALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHVGTEVVLELKYWMMTEFRSFSHLLQWKQRVMLLKRQCWQFMSVGMLLFSSYFYLQSTIYEQAKTLAFAGQVIIIIKPKKLEACPDCLEHICEFSLGRLGSCL

SEQ ID NO: 28612 - protein, 344 aa, Homo sapiens
  ENSP00000477141
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRYGKPGCNAETCDYFLSYRMIGADVEFELSADTDGWVAVGFSSDKKMGGDDVMACVHDDNGRVRIQHFYNVGQWAKEIQRNPARDEEGVFENNRVTCRFKRPVNVPRDETIVDLHLSWYYLFAWGPAIQGSITRHDIDSPPASERVVSIYKYEDIFMPSAAYQTFSSPFCLLLIVALTFYLLMGTP

SEQ ID NO: 28613 - protein, 3016 aa, Homo sapiens
  ENSP00000493189
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEELQGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 28614 - protein, 3013 aa, Homo sapiens
  ENSP00000445043
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSEVSQRFPTTHPNGRQIMLTYLLPWLHNIELVDSRLLLPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 28615 - protein, 150 aa, Homo sapiens
  ENSP00000398010
MEITTACWRRSCVISFIKGLASPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKS

SEQ ID NO: 28616 - protein, 132 aa, Homo sapiens
  ENSP00000434694
EPHSFNTRMSSFDASLPDMNNLQISEGSKAEAVREEEDTTVHEDDLSSSINELPAAFECSDSFSLDMTEGEEKGNRALDQFTLASPQPVTMPRRPGAATSTSLCVTQMAPVLCIHFMCSPPCLRIFRKGSAS

SEQ ID NO: 28617 - protein, 3012 aa, Homo sapiens
  ENSP00000369600
MASQQDSGFFEISIKYLLKSWSNTSPVGNGYIKPPVPPASGTHREKGPPTMLPINVDPDSKPGEYVLKSLFVNFTTQAERKIRIIMAEPLEKPLTKSLQRGEDPQFDQVISSMSSLSEYCLPSILRTLFDWYKRQNGIEDESHEYRPRTSNKSKSDEQQRDYLMERRDLAIDFIFSLVLIEVLKQIPLHPVIDSLIHDVINLAFKHFKYKEGYLGPNTGNMHIVADLYAEVIGVLAQAKFPAVKKKFMAELKELRHKEQNPYVVQSIISLIMGMKFFRIKMYPVEDFEASLQFMQECAHYFLEVKDKDIKHALAGLFVEILVPVAAAVKNEVNVPCLRNFVESLYDTTLELSSRKKHSLALYPLVTCLLCVSQKQLFLNRWHIFLNNCLSNLKNKDPKMARVALESLYRLLWVYMIRIKCESNTATQSRLITIITTLFPKGSRGVVPRDMPLNIFVKIIQFIAQERLDFAMKEIIFDFLCVGKPAKAFSLNPERMNIGLRAFLVIADSLQQKDGEPPMPVTGAVLPSGNTLRVKKTYLSKTLTEEEAKMIGMSLYYSQVRKAVDNILRHLDKEVGRCMMLTNVQMLNKEPEDMITGERKPKIDLFRTCVAAIPRLLPDGMSKLELIDLLARLSIHMDDELRHIAQNSLQGLLVDFSDWREDVLFGFTNFLLREVNDMHHTLLDSSLKLLLQLLTQWKLVIQTQGKVYEQANKIRNSELIANGSSHRIQSERGPHCSVLHAVEGFALVLLCSFQVATRKLSVLILKEIRALFIALGQPEDDDRPMIDVMDQLSSSILESFIHVAVSDSATLPLTHNVDLQWLVEWNAVLVNSHYDVKSPSHVWIFAQSVKDPWVLCLFSFLRQENLPKHCPTALSYAWPYAFTRLQSVMPLVDPNSPINAKKTSTAGSGDNYVTLWRNYLILCFGVAKPSIMSPGHLRASTPEIMATTPDGTVSYDNKAIGTPSVGVLLKQLVPLMRLESIEITESLVLGFGRTNSLVFRELVEELHPLMKEALERRPENKKRRERRDLLRLQLLRIFELLADAGVISDSTNGALERDTLALGALFLEYVDLTRMLLEAENDKEVEILKDIRAHFSAMVANLIQCVPVHHRRFLFPQQSLRHHLFILFSQWAGPFSIMFTPLDRYSDRNHQITRYQYCALKAMSAVLCCGPVFDNVGLSPDGYLYKWLDNILACQDLRVHQLGCEVVVLLLELNPDQINLFNWAIDRCYTGSYQLASGCFKAIATVCGSRNYPFDIVTLLNLVLFKASDTNREIYEISMQLMQILEAKLFVYSKKVAEQRPGSILYGTHGPLPPLYSVSLALLSCELARMYPELTLPLFSGKPAIPHNTPQRAPDHAYLPAALAAQHRAGGQQAPPPGSSPSSPEDEVKDREGDVTASHGLRGNGWGSPEATSLVLNNLMYMTAKYGDEVPGPEMENAWNALANNEKWSNNLRITLQFLISLCGVSSDTVLLPYIKKVAIYLCRNNTIQTMEELLFELQQTEPVNPIVQHCDNPPFYRFTASSKASAAASGTTSSSNTVVAGQENFPDAEENKILKESDERFSNVIRAHTRLESRYSNSSGGSYDEDKNDPISPYTGWLLTITETKQPQPLPMPCTGGCWAPLVDYLPETITPRGPLHRCNIAVIFMTEMVVDHSVREDWALHLPLLLHAVFLGLDHYRPEVFEHSKKLLLHLLIALSCNSNFHSIASVLLQTREMGEAKTLTVQPAYQPEYLYTGGFDFLREDQSSPVPDSGLSSSSTSSSISLGGSSGNLPQMTQEVEDVDTAAETDEKANKLIEFLTTRAFGPLWCHEDITPKNQNSKSAEQLTNFLRHVVSVFKDSKSGFHLEHQLSEVALQTALASSSRHYAGRSFQIFRALKQPLSAHALSDLLSRLVEVIGEHGDEIQGYVMEALLTLEAAVDNLSDCLKNSDLLTVLSRSSSPDLSSSSKLTASRKSTGQLNMNPGTTSGNTATAERSRHQRSFSVPKKFGVIDRSSDPPRSATLDRIQACTQQGLSSKTRSSSSLKDSLTDPSHINHPTNLLATIFWVTVALMESDFEFEYLMALRLLSRLLAHMPLDKAENREKLEKLQAQLKWADFSGLQQLLLKGFTSLTTTDLTLQLFSLLTPVSKISMVDASHAIGFPLNVLCLLPQLIQHFENPNQFCKDIAERIAQVCLEEKNPKLSNLAHVMTLYKTHSYTRDCATWVNVVCRYLHEAYADITLNMVTYLAELLEKGLPSVQQPLLQVIYSLLSYMDLSVVPVKQFNVEVLKTIEKYVQSVHWREALNILKLVVSRSASLVLPSYQHSDLSKIEIHRVWTSASKELPGKTLDFHFDISETPIIGRRYDELQNSSGRDGKPRAMAVTRSTSSTSSGSNSNVLVPVSWKRPQYSQKRTKEKLVHVLSLCGQEVGLSKNPSVIFSSCGDLDLLEHQTSLVSSEDGAREQENMDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEETNPMELLTTACDSTPAEPHSFNTRMSSFDASLPDMNNLQISEGSKAEAVREEEDTTVHEDDLSSSINELPAAFECSDSFSLDMTEGEEKGNRALDQFTLASFGEGDRGVSPPPSPFFSAILAAFQPAACDDAEEAWRSHINQLMCDSDGSCAVYTFHVFSSLFKNIQKRFCFLTCDAASYLGDNLRGIGSKFVSSSQMLTSCSECPTLFVDAETLLSCGLLDKLKFSVLELQEYLDTYNNRKEATLSWLANCKATFAGGSRDGVITCQPGDSEEKQLELCQRLYKLHFQLLLLFQSYCKLIGQVHEVSSMPELLNMSRELSDLKKHLKEASAVIAADPLYSDGAWSEPTFTSTEAAIQSMLECLKNNELGKALRQIRECRSLWPNDIFGSSSDDEVQTLLNIYFRHQTLGQTGTYALVGSNQSLTEICTKLMELNMEIRDMIRRAQSYRVLTTFLPDSSVSGTSL

SEQ ID NO: 28618 - protein, 749 aa, Homo sapiens
  ENSP00000335651
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEENFGKQEQNFESHYNEILETLAQKYEEKIQALGEKKKEKLEALYGQLVSCGENLDTCKELMETIEEMCHEEKVDFIKDAVAMADRLGKFLKTKTDVEISAQPEFEDQTLDFSDVEQLMGSINTIPAPSAPVINPQVPNSATGSSVRVCWSLYSDDTVESYQLSYRPVQDSSPGTDQAEFTVTVKETYCSVTNLVPNTQYEFWVTAHNRAGPSPSSERAVYMTAPSPPIIKTKEIRSCEEAVLICWESGNLNPVDSYTVELTQAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 28619 - protein, 704 aa, Homo sapiens
  ENSP00000444078
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVSEYPPYMMKRRDPAREQRDWRLSGEAAEAEDLGFGGWGSAGQCQDLREAYRYTHGRASEEYECYVIPEEEDEEEAADVFCVTCKTPIRAFQKVFDEHKEHEVIPLNEALESAKDEIHKNMYKLEKQIIEMENFANHLEEVFITVEENFGKQEQNFESHYNEILETLAQKYEEKIQALGEKKKEKLEALYGQLVSCGENLDTCKELMETIEEMCHEEKVDFIKDAVAMADRLGKFLKTKTDVEISAQPEFEDQTLDFSDVEQLMGSINTIPAPSAPVINPQVPNSATGSSVRVCWSLYSDDTVESYQLSYRPVQDSSPGTDQAAPSPPIIKTKEIRSCEEAVLICWESGNLNPVDSYTVELTQAESPEASGVTESVVGIPTCESVVQLQPGRSYIIYVRALNMGGPSVRSEPATVHTIGSYFRLNKDTCHPWLTISEDGLTAVRSERRTPARELSPSDTHFTRCVAVMGNLIPVRGHHYWEVEVDEHLDYRVGVAFADVRKQEDLGANCLSWCMRHTFASSRHKYEFLHNRTTPDIRITVPPKKIGILLDYEHSKLSFFNVDLSQHLYTFSCQLHEFVHPCFSLEKPGCLKVHNGISMPKHVTFY

SEQ ID NO: 28620 - protein, 101 aa, Homo sapiens
  ENSP00000453127
MEEESGEELGLDRSTPKDFHFYHMDLYDSEDRLHLFPEENTRMRKVVQAEMANESRGAGDGKAQRDLQEEVDELVHLYGLEDDHELGDEFVDENIPRTGVS

SEQ ID NO: 28621 - protein, 6907 aa, Homo sapiens
  ENSP00000401306
MELYLGACSKPAKVAVTKTVASVLAADTQQCRDGVHKTHFAGVGPAQLLDLPLGVKLPVIPGSNAVFYTTNFGEKLFRPSYGFNLTDPYCRLLENQYKSLHDPHLKAYYKRKDILKRLKKGGYITSNNKVVCTLRELNKYRQYLTSLKLDFERNYIKEQRILAKQLHNIPENNQIPQHCDVAQVQNWLLKEGTESIKDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHASPKNKKKTSEDIMLVYPAGDQNTYKETHGHTANAAHQRQNSSNNFTKKNSASVVYQADVQDNGINQKRDGMVSKNSSIFDDRGGINISGQGSIISAQVSPTRNFSRVSQAFLDPSKEEKETNADWDGRPTKRSSYLCESGPQAHATDPGIFSSPVYTNMQQNLLQNCLQEKVTSEELNIIIQNVMTWVVATVTSILYPAITKYEKRLQNNTYPVSDDSILSSDSSSFCSTCSEDFTYRSYTSATTKTFQAEPCAFVVDTSVRRPTTPIKPPPAHVEKTVVGKTCHIKGQSIISKHKYNKTNLLYSYPKLRSCKSDSHLLASFETGTKKSKDATTETDSLGSSLHCDKTAKAMDEMKNLKNVFVNFKCYLKGETEVILESILREIMSDLTQAIPSLSSVTAEVFVEQCEREKEILLSNAHIPSVASEIVENMLEKLESAVEKKCVEMFSQDLSVDIKPSLAASDELLTSSNGKPLKNSMPHTLDPMCDIAEDMVHAILEKLMTLVSFKQNEFLHLKDTNKLSCQQHKTDPICMFLQRAGKNKSSLESDEASLIVNEEVQNLISNIFSQSSLVAYIEEAINAILGYIQTELNNERIIASEETVVLLQLLEDILFQLHQEPVNESFQKSRQPRISSPSDTKEKYRLTGTRLSNSPRSGRPFPPINVPGMVLYSDDENEEIDNIVKNVLDSTFKDEKVKSQEQIPNHWFTKGNTCFECKRNIKPPTKPGSRSKAAFHDWELKTEPPSTNHEDILKKKLSSNKDISTFSQDQKHQIEKASENIVTSILKEMLKDISSVPFGHLDSKTGSEASVLVSEKPQGLSHQEWIDQMFSVSEISTVAQEITDSVLNILHKASNYISNTTKSSISSSVHQISLHNSDTEHIVKEAPNKYPLKTWFDSEKKMKYLSLFDVDPEKPPWLKSGKSEPKPVDDINDKIIRTIFKRLKSFICPKLHMGFKSSLRSQLSKYTAKIVNIVLCAIQNELELHKENLNLREIDHTKSLTDKGFFANTDKKLESLVTSIDDDILASPLLTCIYDMLLSSENAHQRSISLSSRKPKSATDSVDVQSILPNRQDKKSFHKYLATPCTHHSVNGGNHIKENAKLQVLERIGETLHEMLSKLLGTHLHSQLSCSQQSREMTNKNQKMAAALQSNIQLISKAILDYILAKLCGVDMDTSFASCGLKAISESLDIDNPSFASIIEKMAKSTKIISSIVSRRVQEDNKEETKSKAKPVAPVSSKTPSTKEMHPNKLKAVASDILNMVFAKLEGFANGHLEILGAINDGNKKSNKIGWEYESTNISRDTHEASFLSALYMHAKKVSSAILKVIQTELNVTSSDLKTSVENPPPETQILKYVVKLILDAVSSDMFNEMESEGGGIETYRYRPTYGSLPGGAESDSFLEDDAYTAKKIIDERSPQREEVKTRSLKQWALEKTLNKIEVKLKEPHISPIAPIIRNILNEIFQSTLINQLNVLSLSHSNFNGMPHNVDEPTPQTSVQFMDKMMDPLLSEADITIVTDNIVRTVFHKLYSAAMTERNVRENRYKTITFSANVSSHEHTYKGKSSVTALDENPCTFQSRFSVADKETKVNLAEDIVQAILTNLETFATSKVKSLFYSQVNFTVPVALPIQQDHSTLSKALSAKDSYSDEQFSCCSVDHTKSGKTNLCQLSLSKLNTYALQVARRNLQGIKQELDKERENPFLTHDIGISESIASQIVNALLDIISRKGKCDKNSSDKEIDLDQQKGVIEKLLNETKYRKVLQLQIQDTIEGILCDIYEKTLFQNNLSFATPTLKCSIADKHSEENSEMFMEGANKIIPKLSVPKSDVILISNDIVNIVLHNLSSAATLVINAKNPTSARLPLTFCDTFPKIDCQQPLKGSKTERKTERFSYSRNQKSAYADDNQITVVEKEDTQKSATDSCEENANFITKTIFKRLESFATERIDSLITLAFQSKEKSFVIPELENCKQNDSIFYDSSQVESDVNVLKISATETILSQELTDFTFVGRREKLGSTIHLSQARLKTYADVIASAILKLIKNDLDLEIQKIYPYQNNILFQENIIVSEIVDSMLKMLDDKRSVKEICFNSKENSNFSQLALSNEILLGHKEKERSTKQSLFTKYPLEQNQMILENKRQIIVLEEIFMRNGESKNKEKGELLIAVEELLNKLYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTVFSEEKMSVSTWSRKKYESKQFLRNIYDDSSIYQCCEHLTESVLYHLTSSISDGTKKGREKEKAWEIQEATFSKIISIHSQVFESRSISIGELALCISEIIIKILFNNKIIQADIAQKMVAIPTKYTYCPGIVSGGFDDLFQDLLVGVIHVLSKEIEVDYHFESNVRNKSFSMHRNNSVPLCNKINRQASPRDWQFSTQQIGQLFQKNKLSYLACKLNSLVGNLKTSESKEVVNKVFNIVSDLFSPDECLDTGMDSGKIQRTYFYSSNNEQPNSILTNNLQLSSKSVFLLNVVCEKLIRILLEECTSTAFPDKGSVSEETSAEECQLLKMLQSVEDGKSDYRKGGMDCECLQVDYMSDLLENVAEIDQDLLTSDSMLTIISHSLVKSLMDKLSHSIQQAPESLPFANKHLNYRTREIQSSFIKARKSELIELGQSKSSLELRSYDSNSLTVSLNNPSVVSSKIQAPFNKHCAVKSSSVSPFERQRTKEMDKVAIHNKLHQEGIYAGVYSATFLEGIISELFFNLSMSLWGKNKNITVSWLNEMNTLFVNNVVNEFNNAQVTVLRNAEERLCFPPVHTETVSKIVDSVYYDVLQQYELKVACGNNPVYDNASIAEQITNGILLEILDYKLPSCFKEHLIPHSYYPLKPEIILQKLQSNLTEFTSLPRSSSDYSTMLSHSFLEDVIRRLLSQLIPPPITCSSLGKKYLMSSDFNEMSTCIINKVMSAISKHKIWFTIYDNQYLYTGKNLQKMVDSVYCNILQMSDSLVSIQKSIVSRSPIMIDQIASFIIQEIIENHLQPFLSGEVLCHPRTPLDPVSTIVTQVLSEVIESHRPQKQSPLDIHLDSFVREIVARLLSKIFSPKHNTEIELKNMTQRIVNSINRHFNKAKIHILYDDKEQAFFSFNTDIVDELATSVYRNALKQHGLDLAVDKESEDSGIFVENITNLIVAAISDYLLHPLFSGDFSASTYSNSVAENIVQDILSNISKSTEPSQSVPLYNTLLPYTFLEDMIRVLLSKLFSSASSLVLNRDTQKDISRVNFNDIASNLVSDIRMKVSQHEIRFSKEEEETKFIYSEDDIQHLVDSVFANVVQTSGSQESAVQNITSSNDILIDRIAGFIIKHICQKHLQPFVSGKSLSSSDTYFDDERRQLFYTSVYSSTFLEDVISGVLRKIFHRVVGIVQTKSIRDSEDELFEKAEELIHLITGEFSKAQVSIIDNTEERLCLPPVERDVVKTIVDMVYSKVLQEYEMEVVPNKDFLNDTKTLAARITNIILAEIFDFQIHPDLIANLPFKSHSKLSANVLIQRVQYDISKSRFQRQASTMYTTMLSHSHLEKIVTQLTSQISPLNTSAEQSDTTKSDLSNTVIKLINEIMSIISKHEICIIKYGNKKQSMISAKDIQSMVDSIYADLSHSNIYQSITKDKKSISDIPVSKIASFIIKEIFNHHIQSFLSEDKTLLLAAVDQTYKLKAIDPKQRELSFIVNSSVFLEEVISELLCKILYAFSHNMLVTENPDRVKLKLTRIVTTLVNSIVLEFTTSEILVADNFDKNLCFSERYKEMVQKIVNSVYGKVLDQYKSLIQIHRVIQSDTICFGRKIYYLLLEEIYDYQVQSLVSGELESSSYSYPQADNIIRNVLNIITKDSHALPPYITVLPHSLLEDMVYRLLGHVFPSTHTENELKEKKFPPDDEFVEAASKLTDEIIKEISEHEIRLSMAEDNAESMQLEPIENLVDSICNNILKTSEFQAEVQKDADKKGCSFLSKLAGFIMKEIMYHHLQPFLHGEESSFSDLSDYDHVSELAKSGKEKTQPSLYSATFLEDIIIDLVHKFCSLLIITEDSKKNEMAELDIMGLALKLANSLIREFKKSDIKVLPNAEKMFSFPPIDKETVDKISNFVYEQFIEKCTSHDIQKGDESNIAIGMIAALTQKAISAFRIQPLFSGDWSSTFFSFLNPDNITQRVQHLPQNTFTQISRCAKENQLSLPDQSYKDTSSTPDCKNMMSTLEINRGTMNRKKSFKTKDTSVKKGDIQNPVLSSINAIMKSGMINLTSGLATGVTNKKEVDENKVGICTQKHSENVSKVTSTTTVKSKDTQEPNLSETFNNNEIEKKRNLIPTDKKGKDDEIYTHFSLIIDDTEYEKEVLGSDSEIGYKKKIDNARESSFKKDDKLFQLSSLKSKRNLGTTTDTLEIRIRTSSNEGRRDSPTQTCRDEEHHSDYEHVQNVIENIFEDVLELSSSPEPAYYSKLSYDQSPPGDNVLNVIQEISRDSAQSVTTKKVSSSTNKNISAKEKEEEEREKEKVREEIKSEPSKPDDPQNQRESKPGIFPAKFLEDVITEMVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLREVASNQLQSYFCGELTPHQCVEVENIVEKILKDVFQTTDVPLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLDTINSTISNADLSGELDVNRIVQKAQEHAFNVIPELEQEKLDQNLSEEESPIKIVPHVGKKPVKIDPKIISEHLAVISIKTQPLEKLKQECLKRTGHSIAELRRASISGRNYSLGSPDLEKRKTERRTSLDKTGRLDVKPLEAVARNSFQNIRKPDITKVELLKDVQSKNDLIVRLVAHDIDQVYLENYIKEERDSDEDEVVLTQTFAKEEGIKVFEDQVKEVKKPIQSKLSPKSTLSTSSLKKFLSLSKCCQTTASANIESTEAISNQVIESKETHVKRAVAELDMATPKTMPETASSSWEEKPQCKKEEKNLVTEPTHYFIHRIMSSSSYNQEDLISSTGEAEDCHSDPSAKILEESSQEQKPEHGNSVKFITIFERSKDVLGSANPSKEVISETPKPDVSKQGSKMLTKMSSTLSKVFSQCNTNISRSSSPAHQDEH

SEQ ID NO: 28622 - protein, 136 aa, Homo sapiens
  ENSP00000395888
KDQERLMRHRYLDMISRKLEQLERTAEEQRLFLMDREERRQREHTRRKLTLRRKIEEEWKTKEMLLLTRMAEDVKREERIEEQQHRNREESDRKKQDLLEKKMAYHLQKMQDTGFNGEDIGKNTFKYRGQDGTHGE

SEQ ID NO: 28623 - protein, 973 aa, Homo sapiens
  ENSP00000390251
  MOD_RES (1)..(1): Any amino acid
XYQRVREVTGHLPPLNETANFISNSKIKTSDTTQKNSFQSHINSVANDIVESVLGKMYLVVVTSLYENNKSRTEVEISDHNDSLLMKPLRFRETKQAGKISNSPRYAISQAYSYVDSQNISVMENTLLPYLPLQVKKDLIQMVLNKITNFVSLPLKVSPKDNPKPCFKAHLKTRSKITTLPKFTKKTHLGLSAAKAKSKTKLGPGEKTLKDSRSKTAIGLSHIMSAGDAKNLLDTKLPTSELKIYAKDIIINILETIVKEFGKVKQTKALPSDQIIAAGKIVNTVLQELYVTNNCNLAYPMKSSHLRLSQGNIGTGSLPKQQACFYLENVSSQLEHIFPREGIFKKLFDKWQTESNDKENEKCKLLMIAENVLTEISIKAKELEYSLSLLNLPPLENCESRFYNHFKGASTRAEDTKAQINMFGREIVEMLLEKLQLCFLSQIPTPDSEETLSNSKEHITAKSKYGFPNKHSLSSLPIYNTKTKDQISVGSSNQIVQEIVETVLNMLESFVDLQFKHISKYEFSEIVKMPIENLSSIQQKLLNKKMLPKLQPLKMFSDKSESNTINFKENIQNILLRVHSFHSQLLTYAVNIISDMLAVIKNKLDNEISQMEPSSISILKENIVASEIIGTLMDQCTYFNESLIQNLSRESLFQGAENAYTVNQVELATNMKMFTSKLKEGSLGINPSQVSKTGFVFCSDEDMKEKYRVSSDLPTSVRSSVEDTVKNSEPTKRPDSETMPSCSTRNKVQDHRPRESNFGSFDQTMKGNSYLPEGSFLQKLLRKASDSTEAALKQVLSFIEMGKGENLRVFHYENLKPVVEPNQIQTTISPLKICLAAENIVNTVLSSCGFPSQPHTNENREIMKPFFISKQSSLSEVSGGQKDNEKSLLRMQDKKINYIPEEENENLEASREDSSFLQKLKKKEYPKIETVKEVEAFTFADHEMGSNEVHLIARHVTTSVVTYLKNFETTGRC

SEQ ID NO: 28624 - protein, 646 aa, Homo sapiens
  ENSP00000478995
MVKQLIFSSIPETQIQDRCQNVSDKQNQAKLYDTAMKLINSLLKEFSDAQIKVFRPDKGNQFPGGKVSSVPKVPPRYKEPTTDEAPSSIKIKSADKMPPMHKMMRKPSSDKIPSIDKTLVNKVVHSSVCNILNDYGSQDSIWKNINSNGENLARRLTSAVINEIFQRQVNLIFCDEVSVSACLPLESKDVVKKVQKLAQTASKECQTSSPYTIILPHKFLENVISALFSKIFSTISSTKTKEPEDNLSTELNFLQMKLVSAVATEISQDKYMTIQYVETLQSDDDEIIQLVVQSVYNNLLPQFGSQEIIQNCVTSGCKILSENIVDLVLPKPSHADKLSYNIIEEIAVKFLSKLLSIFPKVHKERTKSLETDMQKITSKVLNSVQEFISKSKIKLVPPTKESPTVPVADNATIENIVNSIYTSVLKHSGSYTSVFKDLMGKSNVLSDTIGFLMVNAISNSEFQPQVEEEVSNSELVLEAVKIMEKVIKIIDELKSKEKSSSRKGLTLDAKLLEEVLALFLAKLIRLPSSSSKDEKNLSKTELNKIASQLSKLVTAEISRSSISLIASDPEEHCLNPENTERIYQVVDSVYSNILQQSGTNKEFYYDIKDTNTAFPKKVASLIIDGVSSFPLIQLTQQFQMLISLES

SEQ ID NO: 28625 - protein, 842 aa, Homo sapiens
  ENSP00000265342
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 28626 - protein, 157 aa, Homo sapiens
  ENSP00000427662
MNPVPQMEMQKSPVFCVAHAGSCRPELFLFGHLGSSWGLDLKEEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLAL

SEQ ID NO: 28627 - protein, 673 aa, Homo sapiens
  ENSP00000484273
MKPGGFWLHLTLLGASLPAALGWMDPGTSRGPDVGVGESQAEEPRSFEVTRREGLSSHNELLASCGKKFCSRGSRCVLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 28628 - protein, 846 aa, Homo sapiens
  ENSP00000368462
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 28629 - protein, 837 aa, Homo sapiens
  ENSP00000389270
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTRLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 28630 - protein, 847 aa, Homo sapiens
  ENSP00000305334
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 28631 - protein, 102 aa, Homo sapiens
  ENSP00000431659
MTTASTSQVRQNYHQDSEAAINRQINLELYASYVYLSMVLVHLIHSQQGHLVTRDRRSPTERSSQAGPCMCLMTWRNLSLSLDLSFPACEMGRWVPACSLKD

SEQ ID NO: 28632 - protein, 81 aa, Homo sapiens
  ENSP00000431575
MTTASTSQVRQNYHQDSEAAINRQINLELYASYVYLSMPTGTPGHQGQKKSHRKIIPGRTLYVPDDLEESLPLSGPQFPCL

SEQ ID NO: 28633 - protein, 114 aa, Homo sapiens
  ENSP00000433470
MTTASTSQVRQNYHQDSEAAINRQINLELYASYVYLSMSYYFDRDDVALKNFAKYFLHQSHEEREHAEKLMKLQNQRGGRIFLQDIKPTGTPGHQGQKKSHRKIIPGRTLYVPD

SEQ ID NO: 28634 - protein, 183 aa, Homo sapiens
  ENSP00000273550
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 28635 - protein, 95 aa, Homo sapiens
  ENSP00000432223
MTTASTSQVRQNYHQDSEAAINRQINLELYASYVYLSMSYYFDRDDVALKNFAKYFLHQSHEEREHAEKLMKLQNQRGGRIFLQDIKTVMTGRAG

SEQ ID NO: 28636 - protein, 50 aa, Homo sapiens
  ENSP00000434403
MTTASTSQVRQNYHQDSEAAINRQINLELYASYVYLSMIVTATCLWGSLV

SEQ ID NO: 28637 - protein, 153 aa, Homo sapiens
  ENSP00000433321
MTTASTSQSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 28638 - protein, 113 aa, Homo sapiens
  ENSP00000435111
MKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 28639 - protein, 58 aa, Homo sapiens
  ENSP00000436947
MKLQNQRGGRIFLQDIKKPDCDDWESGLNAMECALHLEKNVNQSLLELHKLATDKNDP

SEQ ID NO: 28640 - protein, 183 aa, Homo sapiens; identical to SEQ ID NO: 28634
  ENSP00000484477

SEQ ID NO: 28641 - protein, 175 aa, Homo sapiens
  ENSP00000366525
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 28642 - protein, 92 aa, Homo sapiens
  ENSP00000343314
MASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 28643 - protein, 92 aa, Homo sapiens; identical to SEQ ID NO: 28642
  ENSP00000466398

SEQ ID NO: 28644 - protein, 92 aa, Homo sapiens; identical to SEQ ID NO: 28642
  ENSP00000393611

SEQ ID NO: 28645 - protein, 92 aa, Homo sapiens; identical to SEQ ID NO: 28642
  ENSP00000465289

SEQ ID NO: 28646 - protein, 92 aa, Homo sapiens; identical to SEQ ID NO: 28642
  ENSP00000468535

SEQ ID NO: 28647 - protein, 92 aa, Homo sapiens; identical to SEQ ID NO: 28642
  ENSP00000467727

SEQ ID NO: 28648 - protein, 115 aa, Homo sapiens
  ENSP00000467818
  MOD_RES (1)..(1): Any amino acid
XFCVGLLTMAKAESPKEHDPFTYDYQSLQIGGLVIAGILFILGILIVLTPPLARASWSYSAAWRPPGGSLSFSYLSTPTGRRCRCKFNQQQRTGEPDEEEGTFRSSIRRLSTRRR

SEQ ID NO: 28649 - protein, 92 aa, Homo sapiens; identical to SEQ ID NO: 28642
  ENSP00000481244

SEQ ID NO: 28650 - protein, 77 aa, Homo sapiens
  ENSP00000466915
MATPTQTPTKAPEEPDPFYYDYNTVQTVGMTLATILFLLGILIVISKKVKCRKADSSPTCKSCKSELPSSAPGGGGV

SEQ ID NO: 28651 - protein, 80 aa, Homo sapiens
  ENSP00000270310
MATPTQTPTKAPEEPDPFYYDYNTVQTVGMTLATILFLLGILIVISKKVKCRKADSRSESPTCKSCKSELPSSAPGGGGV

SEQ ID NO: 28652 - protein, 117 aa, Homo sapiens
  ENSP00000465784
MATPTQTPTKAPEEPDPFYYDYNTVQTVGMTLATILFLLGILIVISKCDPFLGCLSLRFLCWLSSISYPLCPVFLFCLSLPTGKKVKCRKADSRSESPTCKSCKSELPSSAPGGGGV

SEQ ID NO: 28653 - protein, 574 aa, Homo sapiens
  ENSP00000286201
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 28654 - protein, 694 aa, Homo sapiens
  ENSP00000363826
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 28655 - protein, 591 aa, Homo sapiens
  ENSP00000345785
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 28656 - protein, 493 aa, Homo sapiens
  ENSP00000410369
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 28657 - protein, 361 aa, Homo sapiens
  ENSP00000467967
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKDNHCSVSTRAPKCAIWPGPSTPTSW

SEQ ID NO: 28658 - protein, 496 aa, Homo sapiens
  ENSP00000378529
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTYSLSTKRSSPDDGNDVSPYSLSPVSNKSQKLLRSPRKPTRKISKIPFKVLDAPELQDDFYLNLVDWSSLNVLSVGLGTCVYLWSACTSQVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKVKWESVSVLNLFTRIR

SEQ ID NO: 28659 - protein, 404 aa, Homo sapiens
  ENSP00000321800
MDQDYERRLLRQIVIQNENTMPRVTEMRRTLTPASSPVSSPSKHGDRFIPSRAGANWSVNFHRINENEKSPSQNRKAKDATSDNGKDGLAYSALLKNELLGAGIEKVQDPQTEDRRLQPSTPEKKGLFTVTRLCDLSVEGDSVTSVGWSERGNLVAVGTHKGFVQIWDAAAGKKLSMLEGHTARVGALAWNAEQLSSGSRDRMILQRDIRTPPLQSERRLQGHRQEVCGLKWSTDHQLLASGGNDNKLLVWNHSSLSPVQQYTEHLAAVKAIAWSPHQHGLLASGGGTADRCIRFWNTLTGQPLQCIDTGSQVCNLAWSKHANELVSTHGYSQNQILVWKYPSLTQVAKLTGHSYRVLYLAMSPDGEAIVTGAGDETLRFWNVFSKTRSTKESVSVLNLFTRIR

SEQ ID NO: 28660 - protein, 724 aa, Homo sapiens
  ENSP00000262995
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKGQSPKILRLKPHGLERTDSQTIGDFATRRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 28661 - protein, 694 aa, Homo sapiens
  ENSP00000262994
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 28662 - protein, 239 aa, Homo sapiens
  ENSP00000427435
MSGGEVVCSGWLRKSPPEKKLKRYAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPTSQGSSFVSEEGEEYLLLEDFESKTIPLQTHADSAKSTSSETD

SEQ ID NO: 28663 - protein, 48 aa, Homo sapiens
  ENSP00000426668
MNKWVRCICDICGFNPTEEDPVKPPGSSLQAPADLPLAINTAPPSTQA

SEQ ID NO: 28664 - protein, 591 aa, Homo sapiens
  ENSP00000424554
MNKWVRCICDICGFNPTEEDPVKPPGSSLQAPADLPLAINTAPPSTQADSSSATLPPPYQLINVPPHLETLGIQEDPQDYLLLINCQSKKPEPTRTHADSAKSTSSETDCNDNVPSHKNPASSQSKHGMNGFFQQQMIYDSPPSRAPSASVDSSLYNLPRSYSHDVLPKVSPSSTEADGELYVFNTPSGTSSVETQMRHVSISYDIPPTPGNTYQIPRTFPEGTLGQTSKLDTIPDIPPPRPPKPHPAHDRSPVETCSIPRTASDTDSSYCIPTAGMSPSRSNTISTVDLNKLRKDASSQDCYDIPRAFPSDRSSSLEGFHNHFKVKNVLTVGSVSSEELDENYVPMNPNSPPRQHSSSFTEPIQEANYVPMTPGTFDFSSFGMQVPPPAHMGFRSSPKTPPRRPVPVADCEPPPVDRNLKPDRKVKPAPLEIKPLPEWEELQAPVRSPITRSFARDSSRFPMSPRPDSVHSTTSSSDSHDSEENYVPMNPNLSSEDPNLFGSNSLDGGSSPMIKPKGDKQVEYLDLDLDSGKSTPPRKQKSSGSGSSVADERVDYVVVDQQKTLALKSTREAWTDGRQSTESETPAKSVK

SEQ ID NO: 28665 - protein, 176 aa, Homo sapiens
  ENSP00000425921
MDEAWKRRWFVLRSGRLTGDPDVLEYYKNDHAKKPIRIIDLNLCQQVDAGLTFNKKEFENSYIFDINTIDRIFYLVADSEEEMNKWVRCICDICGFNPTEEDPVKPPGSSLQAPADLPLAINTAPPSTQADSSSATLPPPYQLINVPPHLETLGIQEDPQDYLLLINCQSKKPEPT

SEQ ID NO: 28666 - protein, 94 aa, Homo sapiens
  ENSP00000420867
  MOD_RES (1)..(1): Any amino acid
XGRLTGDPDVLEYYKNDHAKKPIRIIDLNLCQQVDAGLTFNKKEFENSYIFDINTIDRIFYLVADSEEEMNKWVRCICDICGFNPTEEGSHFVV

SEQ ID NO: 28667 - protein, 91 aa, Homo sapiens
  ENSP00000426297
  MOD_RES (1)..(1): Any amino acid
XPVKPPGSSLQAPADLPLAINTAPPSTQADSSSATLPPPYQLINVPPHLETLGIQEDPQDYLLLINCQSKKPEPTRNASEECEMKILPCHF

SEQ ID NO: 28668 - protein, 638 aa, Homo sapiens
  ENSP00000343959
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 28669 - protein, 676 aa, Homo sapiens
  ENSP00000354952
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPSRHNTEFRDSTYDLPRSLASHGHTKGSLTGSETDNEDVYTFKTPSNTLCREFGDLLVDNMDVPATPLSAYQIPRTFTLDKNHNAMTVATPGDSAIAPPPRPPKPSQAETPRWGSPQQRPPISENSRSVAATIPRRNTLPAMDNSRLHRASSCETYEYPQRGGESAGRSAESMSDGVGSFLPGKMIVGRSDSTNSEDNYVPMNPGSSTLLAMERAGDNSQSVYIPMSPGAHHFDSLGYPSTTLPVHRGPSRGSEIQPPPVNRNLKPDRKAKPTPLDLRNNTVIDELPFKSPITKSWSRANHTFNSSSSQYCRPISTQSITSTDSGDSEENYVPMQNPVSASPVPSGTNSPAPKKSTGSVDYLALDFQPSSPSPHRKPSTSSVTSDEKVDYVQVDKEKTQALQNTMQEWTDVRQSSEPSKGAKL

SEQ ID NO: 28670 - protein, 130 aa, Homo sapiens
  ENSP00000433762
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPT

SEQ ID NO: 28671 - protein, 102 aa, Homo sapiens
  ENSP00000431868
MSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRS

SEQ ID NO: 28672 - protein, 43 aa, Homo sapiens
  ENSP00000443122
MKFQYKEDHPFEYRKKEGEKIRKKYPDRVPAPGLVWGQPASSC

SEQ ID NO: 28673 - protein, 43 aa, Homo sapiens; identical to SEQ ID NO: 28672
  ENSP00000438029

SEQ ID NO: 28674 - protein, 70 aa, Homo sapiens
  ENSP00000444108
MKFQYKEDHPFEYRKKEGEKIRKKYPDRVPVIVEKAPKARVPDLDKRKYLVPSDLTVGQFYFLIRKRIHL

SEQ ID NO: 28675 - protein, 117 aa, Homo sapiens
  ENSP00000266458
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 28676 - protein, 146 aa, Homo sapiens
  ENSP00000411256
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEVMVLVAQYWMPSSAVWHPLALVLDALITHLRSGAEGVIYPDPLTYGSVRL

SEQ ID NO: 28677 - protein, 27 aa, Homo sapiens
  ENSP00000439734
MGQLYEDNHEEDYFLYVAYSDESVYGK

SEQ ID NO: 28678 - protein, 36 aa, Homo sapiens
  ENSP00000441165
MKFQYKEDHPFEYRKKEGEKIRKKYPDRVPLASSTS

SEQ ID NO: 28679 - protein, 36 aa, Homo sapiens; identical to SEQ ID NO: 28678
  ENSP00000446297

SEQ ID NO: 28680 - protein, 146 aa, Homo sapiens; identical to SEQ ID NO: 28676
  ENSP00000445857

SEQ ID NO: 28681 - protein, 43 aa, Homo sapiens; identical to SEQ ID NO: 28672
  ENSP00000443720

SEQ ID NO: 28682 - protein, 43 aa, Homo sapiens; identical to SEQ ID NO: 28672
  ENSP00000444055

SEQ ID NO: 28683 - protein, 117 aa, Homo sapiens; identical to SEQ ID NO: 28675
  ENSP00000444186

SEQ ID NO: 28684 - protein, 103 aa, Homo sapiens
  ENSP00000445709
MKFQYKEDHPFEYRKKEGEKIRKKYPDRVPVSVEERRGWEGKGPRGRGRVVEMASLGRPGGSGEGRFRELLNPERPSVPEPMDVQTVELLKPRMPGPRTPLQG

SEQ ID NO: 28685 - protein, 27 aa, Homo sapiens
  ENSP00000446456
MGQLYEDNHEEDYFLYVAYSDESVYGK

SEQ ID NO: 28686 - protein, 27 aa, Homo sapiens
  ENSP00000444738
MGQLYEDNHEEDYFLYVAYSDESVYGK

SEQ ID NO: 28687 - protein, 27 aa, Homo sapiens
  ENSP00000444209
MGQLYEDNHEEDYFLYVAYSDESVYGK

SEQ ID NO: 28688 - protein, 10 aa, Homo sapiens
  ENSP00000437451
MGQLYEDNHE

SEQ ID NO: 28689 - protein, 43 aa, Homo sapiens; identical to SEQ ID NO: 28672
  ENSP00000486133

SEQ ID NO: 28690 - protein, 961 aa, Homo sapiens
  ENSP00000411286
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 28691 - protein, 844 aa, Homo sapiens
  ENSP00000394528
MGPGAPFARVGWPLPLLVVMAAGVAPVWASHSPHLPRPHSRVPPHPSSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 28692 - protein, 899 aa, Homo sapiens
  ENSP00000399318
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 28693 - protein, 844 aa, Homo sapiens; identical to SEQ ID NO: 28691
  ENSP00000391572

SEQ ID NO: 28694 - protein, 578 aa, Homo sapiens
  ENSP00000448654
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 28695 - protein, 844 aa, Homo sapiens; identical to SEQ ID NO: 28691
  ENSP00000348248

SEQ ID NO: 28696 - protein, 131 aa, Homo sapiens
  ENSP00000419356
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCGTLPSETQASALPGLQHGQVWEGAGDQAREAGRQW

SEQ ID NO: 28697 - protein, 899 aa, Homo sapiens; identical to SEQ ID NO: 28692
  ENSP00000366215

SEQ ID NO: 28698 - protein, 844 aa, Homo sapiens; identical to SEQ ID NO: 28691
  ENSP00000366211

SEQ ID NO: 28699 - protein, 137 aa, Homo sapiens
  ENSP00000417478
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHL

SEQ ID NO: 28700 - protein, 961 aa, Homo sapiens; identical to SEQ ID NO: 28690
  ENSP00000366233

SEQ ID NO: 28701 - protein, 578 aa, Homo sapiens; identical to SEQ ID NO: 28694
  ENSP00000419061

SEQ ID NO: 28702 - protein, 97 aa, Homo sapiens
  ENSP00000417663
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCV

SEQ ID NO: 28703 - protein, 193 aa, Homo sapiens
  ENSP00000420602
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQGTLPSETQASALPGLQHGQVWEGAGDQAREAGRQW

SEQ ID NO: 28704 - protein, 156 aa, Homo sapiens
  ENSP00000419755
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPH

SEQ ID NO: 28705 - protein, 133 aa, Homo sapiens
  ENSP00000417332
MPGAWMLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVD

SEQ ID NO: 28706 - protein, 578 aa, Homo sapiens; identical to SEQ ID NO: 28694
  ENSP00000366176

SEQ ID NO: 28707 - protein, 961 aa, Homo sapiens; identical to SEQ ID NO: 28690
  ENSP00000373134

SEQ ID NO: 28708 - protein, 844 aa, Homo sapiens; identical to SEQ ID NO: 28691
  ENSP00000373132

SEQ ID NO: 28709 - protein, 899 aa, Homo sapiens; identical to SEQ ID NO: 28692
  ENSP00000373133

SEQ ID NO: 28710 - protein, 844 aa, Homo sapiens; identical to SEQ ID NO: 28691
  ENSP00000373135

SEQ ID NO: 28711 - protein, 578 aa, Homo sapiens; identical to SEQ ID NO: 28694
  ENSP00000449342

SEQ ID NO: 28712 - protein, 961 aa, Homo sapiens; identical to SEQ ID NO: 28690
  ENSP00000406066

SEQ ID NO: 28713 - protein, 844 aa, Homo sapiens; identical to SEQ ID NO: 28691
  ENSP00000408938

SEQ ID NO: 28714 - protein, 899 aa, Homo sapiens; identical to SEQ ID NO: 28692
  ENSP00000399861

SEQ ID NO: 28715 - protein, 844 aa, Homo sapiens; identical to SEQ ID NO: 28691
  ENSP00000411263

SEQ ID NO: 28716 - protein, 578 aa, Homo sapiens; identical to SEQ ID NO: 28694
  ENSP00000448531

SEQ ID NO: 28717 - protein, 961 aa, Homo sapiens; identical to SEQ ID NO: 28690
  ENSP00000448999

SEQ ID NO: 28718 - protein, 961 aa, Homo sapiens; identical to SEQ ID NO: 28690
  ENSP00000373034

SEQ ID NO: 28719 - protein, 844 aa, Homo sapiens; identical to SEQ ID NO: 28691
  ENSP00000373029

SEQ ID NO: 28720 - protein, 899 aa, Homo sapiens; identical to SEQ ID NO: 28692
  ENSP00000373033

SEQ ID NO: 28721 - protein, 844 aa, Homo sapiens; identical to SEQ ID NO: 28691
  ENSP00000373035

SEQ ID NO: 28722 - protein, 578 aa, Homo sapiens; identical to SEQ ID NO: 28694
  ENSP00000449449

SEQ ID NO: 28723 - protein, 844 aa, Homo sapiens; identical to SEQ ID NO: 28691
  ENSP00000406285

SEQ ID NO: 28724 - protein, 899 aa, Homo sapiens; identical to SEQ ID NO: 28692
  ENSP00000412167

SEQ ID NO: 28725 - protein, 961 aa, Homo sapiens; identical to SEQ ID NO: 28690
  ENSP00000388035

SEQ ID NO: 28726 - protein, 844 aa, Homo sapiens; identical to SEQ ID NO: 28691
  ENSP00000406499

SEQ ID NO: 28727 - protein, 578 aa, Homo sapiens; identical to SEQ ID NO: 28694
  ENSP00000446983

SEQ ID NO: 28728 - protein, 961 aa, Homo sapiens
  ENSP00000416731
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 28729 - protein, 844 aa, Homo sapiens; identical to SEQ ID NO: 28691
  ENSP00000416903

SEQ ID NO: 28730 - protein, 899 aa, Homo sapiens
  ENSP00000412044
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 28731 - protein, 844 aa, Homo sapiens; identical to SEQ ID NO: 28691
  ENSP00000405709

SEQ ID NO: 28732 - protein, 578 aa, Homo sapiens
  ENSP00000448763
MLLLLLLAPLFLRPPGAGGVQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 28733 - protein, 941 aa, Homo sapiens
  ENSP00000259455
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 28734 - protein, 183 aa, Homo sapiens
  ENSP00000489352
VRTWILTVGYTTAFGAMFAKTWRVHAIFKNVKMKKKIIKDQKLLVIVGGMLLIDLCILICWQAVDPLRRTVEKYSMELFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTS

SEQ ID NO: 28735 - protein, 77 aa, Homo sapiens
  ENSP00000490789
MVFGGVCPSVTSIIAESLQGWNLVQLSFAATTPVLADKKKYPYFFRTVPSDNAVNPAILKLLKHYQWKRVGTLTQDV

SEQ ID NO: 28736 - protein, 451 aa, Homo sapiens
  ENSP00000421828
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 28737 - protein, 451 aa, Homo sapiens; identical to SEQ ID NO: 28736
  ENSP00000421300

SEQ ID NO: 28738 - protein, 451 aa, Homo sapiens; identical to SEQ ID NO: 28736
  ENSP00000371033

SEQ ID NO: 28739 - protein, 451 aa, Homo sapiens; identical to SEQ ID NO: 28736
  ENSP00000348897

SEQ ID NO: 28740 - protein, 66 aa, Homo sapiens
  ENSP00000486333
MKTKLNIYNMQFLLFVFLVWDPARLVLANIQEDEAKNNITIFTRILDRLLDGYDNRLRPGLGGIYN

SEQ ID NO: 28741 - protein, 159 aa, Homo sapiens
  ENSP00000422642
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMR

SEQ ID NO: 28742 - protein, 511 aa, Homo sapiens
  ENSP00000427603
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 28743 - protein, 66 aa, Homo sapiens; identical to SEQ ID NO: 28740
  ENSP00000421639

SEQ ID NO: 28744 - protein, 367 aa, Homo sapiens
  ENSP00000423840
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKVSESFRVIIIKKIP

SEQ ID NO: 28745 - protein, 56 aa, Homo sapiens
  ENSP00000425240
SSTGEYTVMTAHFHLKRKIGYFVIQTYLPCIMTVILSQVSFWLNRESVPARTVFGE

SEQ ID NO: 28746 - protein, 66 aa, Homo sapiens; identical to SEQ ID NO: 28740
  ENSP00000425526

SEQ ID NO: 28747 - protein, 151 aa, Homo sapiens
  ENSP00000424362
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDD

SEQ ID NO: 28748 - protein, 137 aa, Homo sapiens
  ENSP00000424093
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAH

SEQ ID NO: 28749 - protein, 73 aa, Homo sapiens
  ENSP00000422805
MKTKLNIYNMQFLLFVFLVWDPARLVLANIQEDEAKNNITIFTRILDRLLDGYDNRLRPGLGVSRVESPVCVT

SEQ ID NO: 28750 - protein, 427 aa, Homo sapiens
  ENSP00000444409
MEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 28751 - protein, 554 aa, Homo sapiens [sequence omitted]

SEQ ID NO: 28752 - protein, 36 aa, Homo sapiens
  ENSP00000422152
MVSAKKFKRIPRTEPKGGEIVHRKFHPHPGQFARWL

SEQ ID NO: 28753 - protein, 36 aa, Homo sapiens; identical to SEQ ID NO: 28752
  ENSP00000425445

SEQ ID NO: 28754 - protein, 36 aa, Homo sapiens
  ENSP00000424386
MVSAKKVPAIALSAGVSFALLRFLCLAVWSCYRSEN

SEQ ID NO: 28755 - protein, 453 aa, Homo sapiens
  ENSP00000274545
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 28756 - protein, 443 aa, Homo sapiens
  ENSP00000430527
MASSLPWLCIILWLENALGKLEVEGNFYSENVSRILDNLLEGYDNRLRPGFGGAVTEVKTDIYVTSFGPVSDVEMTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 28757 - protein, 197 aa, Homo sapiens
  ENSP00000429943
  MOD_RES (1)..(1): Any amino acid
XIEDGPVGVLGTLFQEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVIL

SEQ ID NO: 28758 - protein, 185 aa, Homo sapiens
  ENSP00000430212
SRCSGDSVPGTDGCSIHKRVFIEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQR

SEQ ID NO: 28759 - protein, 191 aa, Homo sapiens
  ENSP00000427989
LMVSKIWTPDTFFRNGKKSIAHNMTTPNKLFRIMQNGTILYTMRLTINADCPMRLVNFPMDGHACPLKFGSYNVHFEGKKDNSSNSLLYLICFKYLDAYPKSEIIYTWKKGPLYSVEVPEESSSLLQYDLIGQTVSSETIKSNTGEYVIMTVYFHLQRKMGYFMIQIYTPCIMTVILSQVSFWINKESVPA

SEQ ID NO: 28760 - protein, 117 aa, Homo sapiens
  ENSP00000426753
MSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVL

SEQ ID NO: 28761 - protein, 474 aa, Homo sapiens
  ENSP00000295454
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 28762 - protein, 87 aa, Homo sapiens
  ENSP00000426766
MWTVQNRESLGLLSFPVMITMVCCAHSTNEPSNMSYVKETVDRLLKGYDIRLRPDFGGLYTHHVFPAVLERQKAFLFWNPTEPHPRQ

SEQ ID NO: 28763 - protein, 452 aa, Homo sapiens [sequence omitted]

SEQ ID NO: 28764 - protein, 395 aa, Homo sapiens
  ENSP00000491632
MDAPARLLAPLLLLCAQQLRGTRAMNDIGDYVGSNLEISWLPNLDGLIAGYARNFRPGIGGPPVNVALALEVASIDHISEANMVGATSLCLRHGVHHDGVPAPELAGQQALLQPHQRDPGSGQPLRGQAVAARHLHRERQVGLVPRRDGGEQAHPAAARRRDPVQHPNHLHCGLRHGPGQIPHGRAGVHAGPGELRLLIGGHRLLLVGEPGAHPRAGQAAAGAVHHHQLPLHHGADELQVRWPVPTAQPALPPAEEPRRVHHPILHALRPAGRHVLGLLLDQPGGGARQGVSRHHHGADDDHAHGQCPLLPATGISHQGTGRLLLDLLCLRVCRPGGVRLCSFQRRLQEEAEGQGQGLQAEGRDGREERHCPLLPLCCRRHAGAGHLPPAAPRPG

SEQ ID NO: 28765 - protein, 35 aa, Homo sapiens
  ENSP00000491997
MDAPARLLAPLLLLCAQQLRGTRRTGMTITTNWTA

SEQ ID NO: 28766 - protein, 480 aa, Homo sapiens
  ENSP00000491844
MDAPARLLAPLLLLCAQQLRGTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESCFLCGRSAPARAPGAGPGSAAHLCAFPPDGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLGITTVLTMTTLMVSARSSLPRASAIKALDVYFWICYVFVFAALVEYAFAHFNADYRKKQKAKVKVSRPRAEMDVRNAIVLFSLSAAGVTQELAISRRQRRVPGNLMGSYRSVGVETGETKKEGAARSGGQGGIRARLRPIDADTIDIYARAVFPAAFAAVNVIYWAAYAM

SEQ ID NO: 28767 - protein, 500 aa, Homo sapiens
  ENSP00000492435
MDAPARLLAPLLLLCAQQLRGTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLGITTVLTMTTLMVSARSSLPRASAIKALDVYFWICYVFVFAALVEYAFAHFNADYRKKQKAKVKVSRPRAEVRAWGRARDSTAGGPNQDPSAAPAHCGSQLCSLSVGGWSCWSRRGPRMGTPVVQGPGSCTPVLSPVSPTGLRADGREERHCPLLPLCCRRHAGAGHLPPAAPRPGEPDGLLQVGGGGDRGDEEGGGSPLRRPGGHPCPAQAHRRRHH

SEQ ID NO: 28768 - protein, 429 aa, Homo sapiens
  ENSP00000492500
MDAPARLLAPLLLLCAQQLRGTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLAIKALDVYFWICYVFVFAALVEYAFAHFNADYRKKQKAKVKVSRPRAEMDVRNAIVLFSLSAAGVTQELAISRRQRRVPGNLMGSYRSVGVETGETKKEGAARSGGQGGIRARLRPIDADTIDIYARAVFPAAFAAVNVIYWAAYAM

SEQ ID NO: 28769 - protein, 380 aa, Homo sapiens
  ENSP00000491411
GTRAMNDIGDYVGSNLEISWLPNLDGLIAGYARNFRPGIGGPPVNVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSGITTVLTMTTLMVSARSSLPRASAIKALDVYFWICYVFVFAALVEYAFAHFNADYRKKQKAKVKVSRPRAEMDVRNAIVLFSLSAAGVTQELAISRRQRRVPGNLMGSYRSVGVETGETKKEGAARSGGQGGIRARLRPIDADTIDIYARAVFPAAFAAVNVIYWAAYAM

SEQ ID NO: 28770 - protein, 320 aa, Homo sapiens
  ENSP00000491287
  MOD_RES (1)..(1): Any amino acid
XVALALEVASIDHISEANMEYTMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLGTGPRRCSEGAGRAALGNRTPHPSAGGSALASGPCQLSWGSGQPGQARHHHGADDDHAHGQCPLLPATGISHQGTGRLLLDLLCLRVCRPGGVRLCSFQRRL

SEQ ID NO: 28771 - protein, 168 aa, Homo sapiens
  ENSP00000492352
  MOD_RES (1)..(1): Any amino acid
XMTVFLHQSWRDSRLSYNHTNETLGLDSRFVDKLWLPDTFIVNAKSAWFHDVTVENKLIRLQPDGVILYSIRITSTVACDMDLAKYPMDEQECMLDLESYGYSSEDIVYYWSESQEHIHGLDKLQLAQFTITSYRFTTELMNFNWPVPTAQPALPPAEEPRRVHHPIL

SEQ ID NO: 28772 - protein, 168 aa, Homo sapiens
  ENSP00000491871
EQECMLDLESYGYSSEDIVYYWSESQEHIHGLDKLQLAQFTITSYRFTTELMNFKSAGQFPRLSLHFHLRRNRGVYIIQSYMPSVLLVAMSWVSFWISQAAVPARVSLVPAPPCHGHQPSRHWTSTSGSAMSSCLPPWWSTPLLISTPTTGRSRRPRSRSPGRGQRWT

SEQ ID NO: 28773 - protein, 397 aa, Homo sapiens
  ENSP00000491958
VWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPKVVLLRVGILPASYNKDMRTGFQTSSDESFGKSPLALSVSYAIAE

SEQ ID NO: 28774 - protein, 380 aa, Homo sapiens
  ENSP00000492869
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28775 - protein, 372 aa, Homo sapiens
  ENSP00000491763
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28776 - protein, 290 aa, Homo sapiens
  ENSP00000491582
MYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPVCIIFHWHH

SEQ ID NO: 28777 - protein, 475 aa, Homo sapiens
  ENSP00000492125
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28778 - protein, 445 aa, Homo sapiens
  ENSP00000492096
MTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28779 - protein, 467 aa, Homo sapiens
  ENSP00000491909
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28780 - protein, 453 aa, Homo sapiens
  ENSP00000492581
MTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28781 - protein, 385 aa, Homo sapiens
  ENSP00000491240
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKV

SEQ ID NO: 28782 - protein, 446 aa, Homo sapiens
  ENSP00000492293
MDPGENAFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28783 - protein, 385 aa, Homo sapiens
  ENSP00000491557
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPVCIIFHWHH

SEQ ID NO: 28784 - protein, 45 aa, Homo sapiens
  ENSP00000491245
MSSPNIWSTGSSVYSTPVFSQKMTVWILLLLSLYPGRLCGHVCLL

SEQ ID NO: 28785 - protein, 515 aa, Homo sapiens
  ENSP00000410732
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSWSRSIAQAGMCSGVISAHYSLRFWGSTDPPTLASRVAGISDGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28786 - protein, 111 aa, Homo sapiens
  ENSP00000430732
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMHH

SEQ ID NO: 28787 - protein, 507 aa, Homo sapiens
  ENSP00000354651
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSWSRSIAQAGMCSGVISAHYSLRFWGSTDPPTLASRVAGISDGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28788 - protein, 498 aa, Homo sapiens
  ENSP00000493461
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPIHHHIGDIVEKQPRISREQLTDPSPSLPSSQAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28789 - protein, 28 aa, Homo sapiens
  ENSP00000492545
  MOD_RES (1)..(1): Any amino acid
XYSTPVFSQKMTVWILLLLSLYPGWLST

SEQ ID NO: 28790 - protein, 39 aa, Homo sapiens
  ENSP00000430124
  MOD_RES (1)..(1): Any amino acid
XYSTPVFSQKMTVWILLLLSLYPGRKLSSYPHKLRFENE

SEQ ID NO: 28791 - protein, 476 aa, Homo sapiens
  ENSP00000349000
  MOD_RES (1)..(1): Any amino acid
XYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSEDKLHEILVNLTLGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28792 - protein, 91 aa, Homo sapiens
  ENSP00000491621
  MOD_RES (1)..(1): Any amino acid
XKMTVWILLLLSLYPGFTSQKSDDDYEDYASNKTWVLTPKVPEGDVTVILNNLLEGYDNKLRPDIGVKPTLIHTDMYVNSIGPVNAINMHH

SEQ ID NO: 28793 - protein, 264 aa, Homo sapiens
  ENSP00000492659
MDYDLHKDGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 28794 - protein, 119 aa, Homo sapiens
  ENSP00000492329
MNPVPQMEMQKSPVFCVAQAGSCRPELFIFRHLGSSPRFTSQKSDDDYEDYASNKTWVLTPKVPEGDVTVILNNLLEGYDNKLRPDIGVKPTLIHTDMYVNSIGPVNAINMEYTIDIFF

SEQ ID NO: 28795 - protein, 467 aa, Homo sapiens
  ENSP00000479113
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 28796 - protein, 253 aa, Homo sapiens
  ENSP00000452244
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGRNLLKEAQLSKAREA

SEQ ID NO: 28797 - protein, 258 aa, Homo sapiens
  ENSP00000451862
EAGVRGTEEDGCWVCNLESVSQSQTWQENKLSEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAM

SEQ ID NO: 28798 - protein, 38 aa, Homo sapiens
  ENSP00000450976
  MOD_RES (1)..(1): Any amino acid
XAECQLQLHNFPMDEHSCPLIFSSSTILAFRLSLHAYR

SEQ ID NO: 28799 - protein, 169 aa, Homo sapiens
  ENSP00000390708
  MOD_RES (1)..(1): Any amino acid
XDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSKPSCCPACGLQGLPFRSLVSHPRISRAFCLPV

SEQ ID NO: 28800 - protein, 288 aa, Homo sapiens
  ENSP00000331912
MDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 28801 - protein, 585 aa, Homo sapiens
  ENSP00000365437
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 28802 - protein, 585 aa, Homo sapiens; identical to SEQ ID NO: 28801
  ENSP00000259271

SEQ ID NO: 28803 - protein, 188 aa, Homo sapiens
  ENSP00000390434
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGIVSSKIIKLFFRLQ

SEQ ID NO: 28804 - protein, 129 aa, Homo sapiens
  ENSP00000365424
MNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGT

SEQ ID NO: 28805 - protein, 165 aa, Homo sapiens
  ENSP00000360025
MTLEEFSAGEQKTERMDKVGDALEEVLSKALSQRTITVGVYEAAKLLNVDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 28806 - protein, 131 aa, Homo sapiens
  ENSP00000360024
MTLEEFSAGEQKTESDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 28807 - protein, 60 aa, Homo sapiens
  ENSP00000482814
MTLEEFSAGEQKTERMDKVGDALEEVLSKALSQRTITVGVYEAAKLLNVIHIHLNGRILP

SEQ ID NO: 28808 - protein, 423 aa, Homo sapiens
  ENSP00000385825
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 28809 - protein, 423 aa, Homo sapiens; identical to SEQ ID NO: 28808
  ENSP00000385735

SEQ ID NO: 28810 - protein, 423 aa, Homo sapiens; identical to SEQ ID NO: 28808
  ENSP00000384122

SEQ ID NO: 28811 - protein, 423 aa, Homo sapiens; identical to SEQ ID NO: 28808
  ENSP00000384388

SEQ ID NO: 28812 - protein, 423 aa, Homo sapiens; identical to SEQ ID NO: 28808
  ENSP00000385207

SEQ ID NO: 28813 - protein, 279 aa, Homo sapiens
  ENSP00000390545
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLN

SEQ ID NO: 28814 - protein, 265 aa, Homo sapiens
  ENSP00000395080
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKD

SEQ ID NO: 28815 - protein, 242 aa, Homo sapiens
  ENSP00000405017
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEV

SEQ ID NO: 28816 - protein, 199 aa, Homo sapiens
  ENSP00000401426
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQD

SEQ ID NO: 28817 - protein, 170 aa, Homo sapiens
  ENSP00000391485
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLF

SEQ ID NO: 28818 - protein, 163 aa, Homo sapiens
  ENSP00000397092
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITV

SEQ ID NO: 28819 - protein, 149 aa, Homo sapiens
  ENSP00000391996
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEV

SEQ ID NO: 28820 - protein, 143 aa, Homo sapiens
  ENSP00000405381
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMR

SEQ ID NO: 28821 - protein, 112 aa, Homo sapiens
  ENSP00000401074
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNG

SEQ ID NO: 28822 - protein, 102 aa, Homo sapiens
  ENSP00000389876
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKH

SEQ ID NO: 28823 - protein, 100 aa, Homo sapiens
  ENSP00000398380
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQ

SEQ ID NO: 28824 - protein, 98 aa, Homo sapiens
  ENSP00000414542
MLPPQKKPWESMAKGLVLGALFTSFLLLVYSYAVPPLHAGLASTTPEAAASCSPPALEPEAVIRANGSAGECQPRRNIVFLKTHKTASSTLLNILFRF

SEQ ID NO: 28825 - protein, 95 aa, Homo sapiens
  ENSP00000412995
MLPPQKKPWESMAKGLVLGALFTSFLLLVYSYAVPPLHAGLASTTPEAAASCSPPALEPEAVIRANGSAGECQPRRNIVFLKTHKTASSTLLNIL

SEQ ID NO: 28826 - protein, 85 aa, Homo sapiens
  ENSP00000394912
MLPPQKKPWESMAKGLVLGALFTSFLLLVYSYAVPPLHAGLASTTPEAAASCSPPALEPEAVIRANGSAGECQPRRNIVFLKTHK

SEQ ID NO: 28827 - protein, 75 aa, Homo sapiens
  ENSP00000399649
MLPPQKKPWESMAKGLVLGALFTSFLLLVYSYAVPPLHAGLASTTPEAAASCSPPALEPEAVIRANGSAGECQPR

SEQ ID NO: 28828 - protein, 71 aa, Homo sapiens
  ENSP00000390068
MLPPQKKPWESMAKGLVLGALFTSFLLLVYSYAVPPLHAGLASTTPEAAASCSPPALEPEAVIRANGSAGE

SEQ ID NO: 28829 - protein, 423 aa, Homo sapiens; identical to SEQ ID NO: 28808
  ENSP00000343234

SEQ ID NO: 28830 - protein, 110 aa, Homo sapiens
  ENSP00000488800
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKL

SEQ ID NO: 28831 - protein, 132 aa, Homo sapiens
  ENSP00000487594
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHI

SEQ ID NO: 28832 - protein, 118 aa, Homo sapiens
  ENSP00000488586
MGPLSPARTLRLWGPRSLGVALGVFMTIGFALQLLGGPFQRRYFRSCLLTASFFPLSETQRLWLALPSPTINPPHQPSASHHLWLPSWPILEASTGLGPVGTTTLATYYGLTLACPFP

SEQ ID NO: 28833 - protein, 220 aa, Homo sapiens
  ENSP00000414733
MGPLSPARTLRLWGPRSLGVALGVFMTIGFALQLLGGPFQRRYFRSCLLTASFFPLSETQRLWLALPSPTINPPHQPSASHHLWLPSWPILEASTGLGPVGTTTLATYYGLTLACPFPQRRGPREGIFIPPETPTPHSCRSCLLVLALEPKPSIPMPSSILFPLLLIIAARYQALPLSIWGLHPSSSGVWHGWTLSLTWSWWLSTSMSHWFCWQMPCAGV

SEQ ID NO: 28834 - protein, 220 aa, Homo sapiens; identical to SEQ ID NO: 28833
  ENSP00000399066

SEQ ID NO: 28835 - protein, 486 aa, Homo sapiens
  ENSP00000353142
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 28836 - protein, 486 aa, Homo sapiens; identical to SEQ ID NO: 28835
  ENSP00000400451

SEQ ID NO: 28837 - protein, 557 aa, Homo sapiens
  ENSP00000314500
MRRLTRRLVLPVFGVLWITVLLFFWVTKRKLEVPTGPEVQTPKVWSLFFKVAGMSPWAPQVPVSPTPPYQRGHLPTGGHLAVCHFPCLLQEAQFHLQTQVFLQVRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 28838 - protein, 552 aa, Homo sapiens
  ENSP00000288988
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 28839 - protein, 532 aa, Homo sapiens
  ENSP00000385435
MSFPMSLARSSVPFADSGLSSSQPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 28840 - protein, 400 aa, Homo sapiens
  ENSP00000406399
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLES

SEQ ID NO: 28841 - protein, 70 aa, Homo sapiens
  ENSP00000399886
  MOD_RES (1)..(1): Any amino acid
XVFGVLWITVLLFFWVTKRKLEVPTGPEVQTPKVWSLFFKVAGMSPWAPQVPVSPTPPYQRGHLPTAFGR

SEQ ID NO: 28842 - protein, 38 aa, Homo sapiens
  ENSP00000398723
  MOD_RES (1)..(1): Any amino acid
XVFGVLWITVLLFFWVTKRKLEVPTGPEVQTPKGSSQS

SEQ ID NO: 28843 - protein, 639 aa, Homo sapiens
  ENSP00000344260
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 28844 - protein, 617 aa, Homo sapiens
  ENSP00000395873
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQEDENRANSAAAEAYQRPLTFQQIVNNG

SEQ ID NO: 28845 - protein, 141 aa, Homo sapiens
  ENSP00000389079
ALPEVRHPLCLQQHPQDSLPTASVILCFHDEAWSTLLRTVHSILDTVPRAFLKEIILVDDLSQQGSHGFPPGSSGTTQVCSQRICGQAGGGEVTQEQQEAGCHQGPDAGGHQSHRGCARLHGCPLRVPPRLAGAPPQQNSW

SEQ ID NO: 28846 - protein, 196 aa, Homo sapiens
  ENSP00000480229
MERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDEKPASSGVLTRSMLWMNDECQCQKEKRILAIKIQLQVNLKSLYIS

SEQ ID NO: 28847 - protein, 558 aa, Homo sapiens
  ENSP00000336729
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQKWRRKGSFIQHSVSGLCLETKPAQLVTSKCQADAQAQQWQLLPHT

SEQ ID NO: 28848 - protein, 542 aa, Homo sapiens
  ENSP00000451420
MRKIRANAIAILTVAWILGTFYYLWQDNRAHAASSGGRGAQRAGRRSEQLREDRTIPLIVTGTPSKGFDEKAYLSAKQLKAGEDPYRQHAFNQLESDKLSPDRPIRDTRHYSCPSVSYSSDLPATSVIITFHNEARSTLLRTVKSVLNRTPANLIQEIILVDDFSSDPEDCLLLTRIPKVKCLRNDRREGLIRSRVRGADVAAATVLTFLDSHCEVNTEWLPPMLQRVKEDHTRVVSPIIDVISLDNFAYLAASADLRGGFDWSLHFKWEQIPLEQKMTRTDPTRPIRTPVIAGGIFVIDKSWFNHLGKYDAQMDIWGGENFELSFRVWMCGGSLEIVPCSRVGHVFRKRHPYNFPEGNALTYIRNTKRTAEVWMDEYKQYYYEARPSAIGKAFGSVATRIEQRKKMNCKSFRWYLENVYPELTVPVKEALPGIIKQGVNCLESQGQNTAGDFLLGMGICRGSAKNPQPAQAWLFSDHLIQQQGKCLAATSTLMSSPGSPVILQMCNPREGKQVSLLASGPEAQQPEGPCLRVADLGRRAPD

SEQ ID NO: 28849 - protein, 558 aa, Homo sapiens; identical to SEQ ID NO: 28847
  ENSP00000402970

SEQ ID NO: 28850 - protein, 542 aa, Homo sapiens; identical to SEQ ID NO: 28848
  ENSP00000451200

SEQ ID NO: 28851 - protein, 607 aa, Homo sapiens
  ENSP00000227756
MVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHWGQELSPEGRRVALKQFQYYGYNAYLSDRLPLDRPLPDLRPSGCRNLSFPDSLPEVSIVFIFVNEALSVLLRSIHSAMERTPPHLLKEIILVDDNSSNEELKEKLTEYVDKVNSQKPGFIKVVRHSKQEGLIRSRVSGWRAATAPVVALFDAHVEFNVGWAEPVLTRIKENRKRIISPSFDNIKYDNFEIEEYPLAAQGFDWELWCRYLNPPKAWWKLENSTAPIRSPALIGCFIVDRQYFQEIGLLDEGMEVYGGENVELGIRVWQCGGSVEVLPCSRIAHIERAHKPYTEDLTAHVRRNALRVAEVWMDEFKSHVYMAWNIPQEDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQFSQGGPIQNRKSKRCLELQENSDLEFGFQLVLQKCSGQHWSITNVLRSLAS

SEQ ID NO: 28852 - protein, 633 aa, Homo sapiens
  ENSP00000376465
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 28853 - protein, 371 aa, Homo sapiens
  ENSP00000386955
MYGYGCNIFPPSPSNLKGECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 28854 - protein, 464 aa, Homo sapiens
  ENSP00000412643
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQ

SEQ ID NO: 28855 - protein, 89 aa, Homo sapiens
  ENSP00000391104
VHSVLYSSPAILLKEIILVDDASVDEYLHDKLDEYVKQFSIVKIVRQRERKGLITARLLGATVATAETLTFLDAHSFSTGDYSNDSPSR

SEQ ID NO: 28856 - protein, 90 aa, Homo sapiens
  ENSP00000397112
MAHLKRLVKLHIKRHYHKKFWKLGAVIFFFIIVLVLMQREVSVQYSKEESRMERNMKNKNKMLDLMLEAVNNIKDAMPKMQIGAPVRQNI

SEQ ID NO: 28857 - protein, 57 aa, Homo sapiens
  ENSP00000413477
MAHLKRLVKLHIKRHYHKKFWKLGAVIFFFIIVLVLMQREVSVQYSKEESRMERNMK

SEQ ID NO: 28858 - protein, 25 aa, Homo sapiens
  ENSP00000413694
MAHLKRLVKLHIKRHYHKKFWKLGA

SEQ ID NO: 28859 - protein, 11 aa, Homo sapiens
  ENSP00000399880
MAHLKRLVKLH

SEQ ID NO: 28860 - protein, 940 aa, Homo sapiens
  ENSP00000259056
MNRIRKFFRGSGRVLAFIFVASVIWLLFDMAALRLSFSEINTRVIKEDIVRRERIGFRVQPDQGKIFYSSIKEMKPPLRGHGKGAWGKENVRKTEESVLKVEVDLDQTQRERKMQNALGRGKVVPLWHPAHLQTLPVTPNKQKTDGRGTKPEASSHQGTPKQTTAQGAPKTSFIAAKGTQVVKISVHMGRVSLKQEPRKSHSPSSDTSKLAAERDLNVTISLSTDRPKQRSQAVANERAHPASTAVPKSGEAMALNKTKTQSKEVNANKHKANTSLPFPKFTVNSNRLRKQSINETPLGSLSKDDGARGAHGKKLNFSESHLVIITKEEEQKADPKEVSNSKTKTIFPKVLGKSQSKHISRNRSEMSSSSLAPHRVPLSQTNHALTGGLEPAKINITAKAPSTEYNQSHIKALLPEDSGTHQVLRIDVTLSPRDPKAPGQFGRPVVVPHGKEKEAERRWKEGNFNVYLSDLIPVDRAIEDTRPAGCAEQLVHNNLPTTSVIMCFVDEVWSTLLRSVHSVINRSPPHLIKEILLVDDFSTKDYLKDNLDKYMSQFPKVRILRLKERHGLIRARLAGAQNATGDVLTFLDSHVECNVGWLEPLLERVYLSRKKVACPVIEVINDKDMSYMTVDNFQRGIFVWPMNFGWRTIPPDVIAKNRIKETDTIRCPVMAGGLFSIDKSYFFELGTYDPGLDVWGGENMELSFKVWMCGGEIEIIPCSRVGHIFRNDNPYSFPKDRMKTVERNLVRVAEVWLDEYKELFYGHGDHLIDQGLDVGNLTQQRELRKKLKCKSFKWYLENVFPDLRAPIVRASGVLINVALGKCISIENTTVILEDCDGSKELQQFNYTWLRLIKCGEWCIAPIPDKGAVRLHPCDNRNKGLKWLHKSTSVFHPELVNHIVFENNQQLLCLEGNFSQKILKVAACDPVKPYQKWKFEKYYEA

SEQ ID NO: 28861 - protein, 622 aa, Homo sapiens
  ENSP00000444171
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 28862 - protein, 622 aa, Homo sapiens; identical to SEQ ID NO: 28861
  ENSP00000348668

SEQ ID NO: 28863 - protein, 365 aa, Homo sapiens
  ENSP00000474670
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKCGSVGASWRSSPALS

SEQ ID NO: 28864 - protein, 137 aa, Homo sapiens
  ENSP00000474101
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGY

SEQ ID NO: 28865 - protein, 123 aa, Homo sapiens
  ENSP00000474515
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKS

SEQ ID NO: 28866 - protein, 23 aa, Homo sapiens
  ENSP00000474483
MRLLRRRHMPLRLAMVGCAFVLF

SEQ ID NO: 28867 - protein, 23 aa, Homo sapiens
  ENSP00000474163
MRLLRRRHMPLRLAMVGCAFVLF

SEQ ID NO: 28868 - protein, 39 aa, Homo sapiens
  ENSP00000473981
MRLLRRRHMPLRLAMVGCAFVLFLFLLHRDVSSREEATE

SEQ ID NO: 28869 - protein, 55 aa, Homo sapiens
  ENSP00000473948
MRLLRRRHMPLRLAMVGCAFVLFLFLLHRDVSSREEATEKPWLKSLVSRKDHVLD

SEQ ID NO: 28870 - protein, 62 aa, Homo sapiens
  ENSP00000474052
MRLLRRRHMPLRLAMVGCAFVLFLFLLHRDVSSREEATEKPWLKSLVSRKDHVLDLMLEAMN

SEQ ID NO: 28871 - protein, 68 aa, Homo sapiens
  ENSP00000473836
MRLLRRRHMPLRLAMVGCAFVLFLFLLHRDVSSREEATEKPWLKSLVSRKDHVLDLMLEAMNNLRDSM

SEQ ID NO: 28872 - protein, 78 aa, Homo sapiens
  ENSP00000473918
MRLLRRRHMPLRLAMVGCAFVLFLFLLHRDVSSREEATEKPWLKSLVSRKDHVLDLMLEAMNNLRDSMPKLQIRAPEA

SEQ ID NO: 28873 - protein, 61 aa, Homo sapiens
  ENSP00000425590
MKRKQKRFLQMTLLFTVALIFLPNVGLWSLYKDKHLVKSAEPGEQQVSATQRKITQGLVRQ

SEQ ID NO: 28874 - protein, 601 aa, Homo sapiens
  ENSP00000423313
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 28875 - protein, 584 aa, Homo sapiens
  ENSP00000423827
MRAKFRAGAGHQRNPSISADHGVHELVYQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 28876 - protein, 417 aa, Homo sapiens
  ENSP00000483822
EHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 28877 - protein, 349 aa, Homo sapiens
  ENSP00000299727
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKESKSRIDTPPSTNCTHV

SEQ ID NO: 28878 - protein, 238 aa, Homo sapiens
  ENSP00000305010
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 28879 - protein, 274 aa, Homo sapiens
  ENSP00000377372
MTKSCSELCHPALHFLPCLGGLRKNLQRAVRPSPYSLGFLTFWISRVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 28880 - protein, 335 aa, Homo sapiens
  ENSP00000229239
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 28881 - protein, 260 aa, Homo sapiens
  ENSP00000380065
MEEMRDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 28882 - protein, 335 aa, Homo sapiens; identical to SEQ ID NO: 28880
  ENSP00000380070

SEQ ID NO: 28883 - protein, 335 aa, Homo sapiens; identical to SEQ ID NO: 28880
  ENSP00000380068

SEQ ID NO: 28884 - protein, 293 aa, Homo sapiens
  ENSP00000380067
MVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 28885 - protein, 293 aa, Homo sapiens; identical to SEQ ID NO: 28884
  ENSP00000478864

SEQ ID NO: 28886 - protein, 874 aa, Homo sapiens
  ENSP00000384593
MEKLAAGLAGLRWSMGAFPLDLIVSRCRLPTLACLGPGEYAEGVSERDILLIHSCRQWTTVTAHTLEEGHYVIGPKIDIPLQYPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKVGESSSRPAPGPLPSTTQPSQASRALTEPLSGRAASLLGADTPVKTYHSCPPLFKPSHPQKRFAPFGALNPFSGPAYPSGPSAALSSGPRTTSGPVATSGPAYSPGPASPGQAYSAAPPSSCAPSSSSSSEWQEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 28887 - protein, 664 aa, Homo sapiens
  ENSP00000384581
MHRMPDPGKFKLLEQARDVREPVRYFSSVEEVASVFPDRIFVMEAITFSVKVVSGEFSEDSEVYNFTLHAGDELTLMGQAEILCAKTTKERSRFTTLLRKLGRAGALAGVGGGGPASAGAAGGTGGGGARPVKGKMPCLICMNHRTNESLSLPFQCQGRFSTRSPLELQMQEGEHTVRAIIERVRLPVNVLVPSRPPRNPYDLHPVREGHCYKLVSIISKTVVLGLALRREGPAPLHFLLLTDTPRFALPQGLLAGDPRVERLVRDSASYCRERFDPDEYSTAVREAPAELAEDCASPRRARLCLPAPRAPGLARAPGPLAPAPAGEGDQEYVSPDWAAAPEPAAPPAEIPYEELWAHQGPEGLVRPPPGLDLISFGAAGPPRREPEAPPPPVPPKSEAVKEECRLLNAPPVPPRGGNGSGRLSSSPPVPPRFPKLQPVHSPSSSLSYYSSGLQDGAGSRSGSGSPSPDTYSLYCYPCTWGDCKEPVLEPFDPFELGQGSSPEPELLRSQEPRAVGTPGPGPRLSPLGPSKAFEPEGLVLHQVPTPLSPAALQGPEAGGALFLTQGRLEGPPASPRDGATGFGVRDASSWQPPADLSALSLEEVSRSLRFIGLSEDVVSFFARERIDGSIFVQLSEDILADDFHLTKLQVKKIMQFIKGWRPKI

SEQ ID NO: 28888 - protein, 267 aa, Homo sapiens
  ENSP00000400579
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLK

SEQ ID NO: 28889 - protein, 139 aa, Homo sapiens
  ENSP00000411160
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDVHLENPEYHTRWYFKYFLGQVHQNYIGNDA

SEQ ID NO: 28890 - protein, 88 aa, Homo sapiens
  ENSP00000397246
MDPLTKVPCGSQIAQTILWKAKSSLSFGIQPLQTWPTKDPELESQVNLLFPVMLMEPSKGLEDSEWKMALQMRMQLPCLVLGEEQTCT

SEQ ID NO: 28891 - protein, 48 aa, Homo sapiens
  ENSP00000389679
MDPLTKVPCGSQIAQTILWKAKSSLSFGIQPLQTWPTKDPELESQVNL

SEQ ID NO: 28892 - protein, 110 aa, Homo sapiens
  ENSP00000416473
MDPLTKVPCGSQIAQTILWKAKSSLSFGIQPLQTWPTKDPELESQVNLSVSEDLGCRRGDFSRKHYGSVELLISSDADGAIQRAGRFRVENGSSDENATALPGTWRRTDV

SEQ ID NO: 28893 - protein, 48 aa, Homo sapiens; identical to SEQ ID NO: 28891
  ENSP00000396319

SEQ ID NO: 28894 - protein, 167 aa, Homo sapiens
  ENSP00000411329
MKSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQK

SEQ ID NO: 28895 - protein, 1013 aa, Homo sapiens
  ENSP00000362485
MVVDFCRRFVARSLCIILMKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 28896 - protein, 802 aa, Homo sapiens
  ENSP00000362484
MKHFCSSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRVKFNQKICTRFHLETSWAEASNDL

SEQ ID NO: 28897 - protein, 81 aa, Homo sapiens
  ENSP00000474589
  MOD_RES (1)..(1): Any amino acid
XMPDLHKNMLNRRSFSDVLPESPKSARKKEEARQAEFVRIGQALKLKSIVRGDAPSSLAASGICKKEMTFHQCPCLTELCQ

SEQ ID NO: 28898 - protein, 991 aa, Homo sapiens
  ENSP00000396205
MKSSVSEDLGCRRGDFSRKHYGSVELLISSDADGAIQRAGRFRVENGSSDENATALPGTWRRTDVHLENPEYHTRWYFKYFLGQVHQNYIGNDAEKSPFFLSVTLSDQNNQRVPQYRAILWRKTGTQKICLPYSPTKTLSVKSILSAMNLDKFEKGPREIFHPEIQKDLLVLEEQEGSVNFKFGVLFAKDGQLTDDEMFSNEIGSEPFQKFLNLLGDTITLKGWTGYRGGLDTKNDTTGIHSVYTVYQGHEIMFHVSTMLPYSKENKQQVERKRHIGNDIVTIVFQEGEESSPAFKPSMIRSHFTHIFALVRYNQQNDNYRLKIFSEESVPLFGPPLPTPPVFTDHQEFRDFLLVKLINGEKATLETPTFAQKRRRTLDMLIRSLHQDLMPDLHKNMLNRRSFSDVLPESPKSARKKEEARQAEFVRIGQALKLKSIVRGDAPSSLAASGICKKEPWEPQCFCSNFPHEAVCADPWGQALLVSTDAGVLLVDDDLPSVPVFDRTLPVKQMHVLETLDLLVLRADKGKDARLFVFRLSALQKGLEGKQAGKSRSDCRENKLEKTKGCHLYAINTHHSRELRIVVAIRNKLLLITRKHNKPSGVTSTSLLSPLSESPVEEFQYIREICLSDSPMVMTLVDGPAEESDNLICVAYRHQFDVVNESTGEAFRLHHVEANRVNFVAAIDVYEDGEAGLLLCYNYSCIYKKVCPFNGGSFLVQPSASDFQFCWNQAPYAIVCAFPYLLAFTTDSMEIRLVVNGNLVHTAVVPQLQLVASRSDIYFTATAAVNEVSSGGSSKGASARNSPQTPPGRDTPVFPSSLGEGEIQSKNLYKIPLRNLVGRSIERPLKSPLVSKVITPPTPISVGLAAIPVTHSLSLSRMEIKEIASRTRRELLGLSDEGGPKSEGAPKAKSKPRKRLEESQGGPKPGAVRSSSSDRIPSGSLESASTSEANPEGHSASSDQDPVADREGSPVSGSSPFQLTAFSDEDIIDLK

SEQ ID NO: 28899 - protein, 345 aa, Homo sapiens
  ENSP00000298743
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 28900 - protein, 423 aa, Homo sapiens
  ENSP00000379895
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGITTIKVNIRNANSLGGGFHCWTCDVRRRGTLQSYLD

SEQ ID NO: 28901 - protein, 391 aa, Homo sapiens
  ENSP00000454008
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVKANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAAQGKFVTTEFEPCFDAADFIRAGRDIFAQRSQVTNYLGIEWMRRHLAPDYRVHIISFKDPNPMHIDATFNIIGPGIVLSNPDRPCHQIDLFKKAGWTIITPPTPIIPDDHPLWMSSKWLSMNVLMLDEKRVMVDANEVPIQKMFEKLGMYNK

SEQ ID NO: 28902 - protein, 167 aa, Homo sapiens
  ENSP00000453781
MLRVRCLRGGSRGAEAVHYIGSRANTYEKYWPFYQKQGGHYFPKDHLKKAVAEIEEMCNILKTEGVTVRRPDPIDWSLKYKTPDFESTGLYSAMPRDILIVVGNEIIEAPMAWRSRFFEYRAYRSIIKDYFHRGAKWTTAPKPTMADELYNQDYPIHSVEDRHKLAA

SEQ ID NO: 28903 - protein, 32 aa, Homo sapiens
  ENSP00000453151
MCNILKTEGVTVRRPDPIDWSLKYKTPDFEST

SEQ ID NO: 28904 - protein, 31 aa, Homo sapiens
  ENSP00000453860
MCNILKTEGVTVRRPDPIDWSLKYKTPDFES

SEQ ID NO: 28905 - protein, 15 aa, Homo sapiens
  ENSP00000453087
MCNILKTEGVTVRRP

SEQ ID NO: 28906 - protein, 96 aa, Homo sapiens
  ENSP00000452971
MLRVRCLRGGSRGAEAVHYIGSRLGRTLTGWVQRTFQSTQAATASSRNSCAADDKATEPLPKDCPVSSYNEWDPLEEVIVGRAENACVPPFTIEVK

SEQ ID NO: 28907 - protein, 329 aa, Homo sapiens
  ENSP00000484732
MELHILEHRLQVASVAKESIPLFTYGLIKLAFLSSKTRCKFFSLTETPEDYTIIVDEEGFLELPSSEHLSVADATWLALNVVSGGGSFSSSQPIGVTKIAKSVIAPLADQNISVFMLSTYQTDFILVRERDLPFVTHTLSSEFTILRVVNGETVAAENLGITNGFVKPKLVQRPVIHPLSSPSNRFCVTSLDPDTLPAVATLLMDVMFYSNGVKDPMATGDDCGHIRFFSFSLIEGYISLVMDVQTQQRFPSNLLFTSASGELWKMVRIGGQPLGFDECGIVAQISEPLAAADIPAYYISTFKFDHALVPEENINGVISALKVSQAEKH

SEQ ID NO: 28908 - protein, 329 aa, Homo sapiens
  ENSP00000384183
MELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHSTPKEAASSSPEPSSITFFAFSLIEGYISIVMDAETQKKFPSDLLLTSSSGELWRMVRIGGQPLGFDECGIVAQIAGPLAAADISAYYISTFNFDHALVPEDGIGSVIEVLQRRQEGLAS

SEQ ID NO: 28909 - protein, 291 aa, Homo sapiens
  ENSP00000385868
MELHILEHRVRVLSVARPGLWLYTHPLIKLLFLPRRSRCKFFSLTETPEDYTLMVDEEGFKELPPSEFLQVAEATWLVLNVSSHSGAAVQAAGVTKIARSVIAPLAEHHVSVLMLSTYQTDFILVREQDLSVVIHTLAQEFDIYREVGGEPVPVTRDDSSNGFPRTQHGPSPTVHPIQSPQNRFCVLTLDPETLPAIATTLIDVLFYSHRFPSDLLLTSSSGELWRMVRIGGQPLGFDECGIVAQIAGPLAAADISAYYISTFNFDHALVPEDGIGSVIEVLQRRQEGLAS

SEQ ID NO: 28910 - protein, 42 aa, Homo sapiens
  ENSP00000411842
MELHILEHRVRVLSVARPGLWLYTHPLIKLLFLPRRSRAAPI

SEQ ID NO: 28911 - protein, 42 aa, Homo sapiens; identical to SEQ ID NO: 28910
  ENSP00000390869

SEQ ID NO: 28912 - protein, 74 aa, Homo sapiens
  ENSP00000416041
MELHILEHRVRVLSVARPGLWLYTHPLIKLLFLPRRSRCKFFSLTETPEDYTLMVDEEGFKDEETETQITHPRS

SEQ ID NO: 28913 - protein, 62 aa, Homo sapiens
  ENSP00000408419
MELHILEHRVRVLSVARPGLWLYTHPLIKLLFLPRRSRCAPGFGSADRGWGLCSRSGPGSED

SEQ ID NO: 28914 - protein, 62 aa, Homo sapiens
  ENSP00000407871
  MOD_RES (1)..(1): Any amino acid
XELHILEHRVRVLSVARPGLWLYTHPLIKLLFLPRRSRCAPGFGSADRGWGLCSRSGPGSED

SEQ ID NO: 28915 - protein, 146 aa, Homo sapiens
  ENSP00000393218
MWRRQEEVLPKINLTSCGFPNTNLFPWEFGGGFEKFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAA

SEQ ID NO: 28916 - protein, 87 aa, Homo sapiens
  ENSP00000412899
MQMGQPVPETGPAILLDGYSGPAYSDTYSSAGDSVYTYFSAVAGQDGEVDAEELQRCLTQSGINGTYSPFSLETCRIMIAMLDRKET

SEQ ID NO: 28917 - protein, 217 aa, Homo sapiens
  ENSP00000394842
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 28918 - protein, 132 aa, Homo sapiens
  ENSP00000403805
MQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLM

SEQ ID NO: 28919 - protein, 198 aa, Homo sapiens
  ENSP00000233612
MQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 28920 - protein, 146 aa, Homo sapiens
  ENSP00000408620
  MOD_RES (1)..(1): Any amino acid
XFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDCGGMNVINFEHLDTERPESVCKSD

SEQ ID NO: 28921 - protein, 233 aa, Homo sapiens
  ENSP00000444011
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATKSNKYNKGLSPLLSSCHLFVAILK

SEQ ID NO: 28922 - protein, 250 aa, Homo sapiens
  ENSP00000419045
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 28923 - protein, 213 aa, Homo sapiens
  ENSP00000445246
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATSAEP

SEQ ID NO: 28924 - protein, 250 aa, Homo sapiens; identical to SEQ ID NO: 28922
  ENSP00000477796

SEQ ID NO: 28925 - protein, 250 aa, Homo sapiens; identical to SEQ ID NO: 28922
  ENSP00000378890

SEQ ID NO: 28926 - protein, 149 aa, Homo sapiens
  ENSP00000338009
GGVRTGMPRAGMGASLRPGTGPHPDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 28927 - protein, 465 aa, Homo sapiens [sequence omitted]

SEQ ID NO: 28928 - protein, 464 aa, Homo sapiens
  ENSP00000379142
MPRPRSQLPQPNSQVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 28929 - protein, 466 aa, Homo sapiens
  ENSP00000223366
MAMDVTRSQAQTALTLVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMLFDYISECISDFLDKHQMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 28930 - protein, 448 aa, Homo sapiens
  ENSP00000402840
MLDDRARMEAAKKEKVEQILAEFQLQEEDLKKVMRRMQKEMDRGLRLETHEEASVKMLPTYVRSTPEGSEVGDFLSLDLGGTNFRVMLVKVGEGEEGQWSVKTKHQMYSIPEDAMTGTAEMMKHKKLPLGFTFSFPVRHEDIDKGILLNWTKGFKASGAEGNNVVGLLRDAIKRRGDFEMDVVAMVNDTVATMISCYYEDHQCEVGMIVGTGCNACYMEEMQNVELVEGDEGRMCVNTEWGAFGDSGELDEFLLEYDRLVDESSANPGQQLYEKLIGGKYMGELVRLVLLRLVDENLLFHGEASEQLRTRGAFETRFVSQVESDTGDRKQIYNILSTLGLRPSTTDCDIVRRACESVSTRAAHMCSAGLAGVINRMRESRSEDVMRITVGVDGSVYKLHPSFKERFHASVRRLTPSCEITFIESEEGSGRGAALVSAVACKKACMLGQ

SEQ ID NO: 28931 - protein, 464 aa, Homo sapiens; identical to SEQ ID NO: 28928
  ENSP00000482149

SEQ ID NO: 28932 - protein, 393 aa, Homo sapiens
  ENSP00000366185
MFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 28933 - protein, 454 aa, Homo sapiens
  ENSP00000351170
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 28934 - protein, 454 aa, Homo sapiens; identical to SEQ ID NO: 28933
  ENSP00000436619

SEQ ID NO: 28935 - protein, 195 aa, Homo sapiens
  ENSP00000403897
MTLFQNTRRPLRNRSRKLRDCHSVTQAGVQWRDLSSLKPPPPVFKRFSCLSLPSSWDYRFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGT

SEQ ID NO: 28936 - protein, 176 aa, Homo sapiens
  ENSP00000434682
  MOD_RES (1)..(1): Any amino acid
XGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 28937 - protein, 179 aa, Homo sapiens
  ENSP00000400857
ERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 28938 - protein, 471 aa, Homo sapiens
  ENSP00000238018
MCAAQMPPLAHIFRGTFVHSTWTCPMEVLRDHLLGVSDSGKIVFLEEASQQEKLAKEWCFKPCEIRELSHHEFFMPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSVKETIHLPASSPHPPPFP

SEQ ID NO: 28939 - protein, 380 aa, Homo sapiens
  ENSP00000437972
MPGLVDTHIHASQYSFAGSSIDLPLLEWLTKYTFPAEHRFQNIDFAEEVYTRVVRRTLKNGTTTACYFATIHTDSSLLLADITDKFGQRAFVGKVCMDLNDTFPEYKETTEESIKETERFVSEMLQKNYSRVKPIVTPRFSLSCSETLMGELGNIAKTRDLHIQSHISENRDEVEAVKNLYPSYKNYTSVYDKNNLLTNKTVMAHGCYLSAEELNVFHERGASIAHCPNSNLSLSSGFLNVLEVLKHEVKIGLGTDVAGGYSYSMLDAIRRAVMVSNILLINKVNEKSLTLKEVFRLATLGGSQALGLDGEIGNFEVGKEFDAILINPKASDSPIDLFYGDFFGDISEAVIQKFLYLGDDRNIEEVYVGGKQVVPFSSSV

SEQ ID NO: 28940 - protein, 478 aa, Homo sapiens
  ENSP00000464145
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 28941 - protein, 407 aa, Homo sapiens
  ENSP00000257868
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 28942 - protein, 380 aa, Homo sapiens
  ENSP00000448390
  MOD_RES (1)..(1): Any amino acid
XAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 28943 - protein, 623 aa, Homo sapiens
  ENSP00000365390
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGNLHIAMKPPVRVVEGPWTLAALYPALPKSGKEHQGHFNFAAPSKKLLPIKNAVTPLKPGKHEIQPPMPTVVFELTQAPTRQATSEATFQTTLPTLKVDKPTMPSIEVPYP

SEQ ID NO: 28944 - protein, 520 aa, Homo sapiens
  ENSP00000320815
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGSKNEEDR

SEQ ID NO: 28945 - protein, 467 aa, Homo sapiens
  ENSP00000434050
MSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 28946 - protein, 135 aa, Homo sapiens
  ENSP00000437123
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKASSGLPLSPL

SEQ ID NO: 28947 - protein, 486 aa, Homo sapiens
  ENSP00000437049
MVRHQPLQYYEPQLCLSCLTGIYGCRWKRYQRSHDDTTPGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 28948 - protein, 605 aa, Homo sapiens
  ENSP00000433214
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 28949 - protein, 605 aa, Homo sapiens; identical to SEQ ID NO: 28948
  ENSP00000337972

SEQ ID NO: 28950 - protein, 360 aa, Homo sapiens
  ENSP00000435196
MSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 28951 - protein, 175 aa, Homo sapiens
  ENSP00000435728
AVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQNYHLIRWRLGGIRSYNPEQIMLSAAVRRTSRDVSIMKEKLIFSEISDGVEVSDVLSVCSDNSYDTYANSTATP

SEQ ID NO: 28952 - protein, 73 aa, Homo sapiens
  ENSP00000433727
MVRHQPLQYYEPQLCLSCLTGIYGCRWKRYQRSHDDTTPWERLWFLLLTFTFGLTLTWLYFWWEVHNDYDEFN

SEQ ID NO: 28953 - protein, 135 aa, Homo sapiens; identical to SEQ ID NO: 28946
  ENSP00000396535

SEQ ID NO: 28954 - protein, 296 aa, Homo sapiens
  ENSP00000379497
MTLNNVTMRQGTVGMQPQQQRWSIPADGRHLMVQKEPHQYSHRNRHSATPEDHCRRSWSSDSTDSVISSESGNTYYRVVLIGEQGVGKSTLANIFAGVHDSMDSDCEVLGEDTYERTLMVDGESATIILLDMWENKGENEWLHDHCMQVGDAYLIVYSITDRASFEKASELRIQLRRARQTEDIPIILVGNKSDLVRCREVSVSEGRACAVVFDCKFIETSAAVQHNVKELFEGIVRQVRLRRDSKEKNERRLAYQKRKESMPRKARRFWGKIVAKNNKNMAFKLKSKSCHDLSVL

SEQ ID NO: 28955 - protein, 296 aa, Homo sapiens; identical to SEQ ID NO: 28954
  ENSP00000297596

SEQ ID NO: 28956 - protein, 93 aa, Homo sapiens
  ENSP00000428258
MTLNNVTMRQGTVGMQPQQQRWSIPADGRHLMVQKEPHQYSHRNRHSATPEDHCRRSWSSDSTDSVISSESGNTYYRVVLIGEQGVGKSTLAN

SEQ ID NO: 28957 - protein, 505 aa, Homo sapiens
  ENSP00000492432
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEGTKQLRTSTSGVWSLALVRSFLGTALEPQDTTSGTALRTLALTQEWVKGNRNEKGGPRCSGREISASVLQALPCQPGGKVFHQPGG

SEQ ID NO: 28958 - protein, 432 aa, Homo sapiens
  ENSP00000466598
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEVIKESKQEHKDVM

SEQ ID NO: 28959 - protein, 69 aa, Homo sapiens
  ENSP00000491042
  MOD_RES (1)..(1): Any amino acid
XEIATYRKLLEGEENRITIPVQTFSNLQIRETSLDTKSVSEGHLKRNIVVKTVEMRDGEGTHPETSGII

SEQ ID NO: 28960 - protein, 15 aa, Homo sapiens
  ENSP00000491375
  MOD_RES (1)..(1): Any amino acid
XRDGEGTHPETSGII

SEQ ID NO: 28961 - protein, 46 aa, Homo sapiens
  ENSP00000491243
  MOD_RES (1)..(1): Any amino acid
XSNLQIRETSLDTKSVSEGHLKRNIVVKTVEMRDGEGTHPETSGII

SEQ ID NO: 28962 - protein, 34 aa, Homo sapiens
  ENSP00000492300
  MOD_RES (1)..(1): Any amino acid
XKSVSEGHLKRNIVVKTVEMRDGEGTHPETSGII

SEQ ID NO: 28963 - protein, 41 aa, Homo sapiens
  ENSP00000491466
  MOD_RES (1)..(1): Any amino acid
XRETSLDTKSVSEGHLKRNIVVKTVEMRDGEGTHPETSGII

SEQ ID NO: 28964 - protein, 67 aa, Homo sapiens
  ENSP00000492860
  MOD_RES (1)..(1): Any amino acid
XKLALDIEIATYRKLLEGEENRITIPVQTFSNLQIRGGKSTKDGENHKKPAWTPSLCQKATSRGTSW

SEQ ID NO: 28965 - protein, 59 aa, Homo sapiens
  ENSP00000491735
VSEGHLKRNIVVKTVEMRDGEGTKQLRTSTSGVWSLALVRSFLGTALEPQDTTSGTALR

SEQ ID NO: 28966 - protein, 472 aa, Homo sapiens
  ENSP00000253408
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGGKSTKDGENHKVTRYLKSLTIRVIPIQAHQIVNGTPPARETSLDTKSVSEGHLKRNIVVKTVEMRDGEVIKESKQEHKDVM

SEQ ID NO: 28967 - protein, 124 aa, Homo sapiens
  ENSP00000467397
KLALDIEIATYRKLLEGEENRITIPVQTFSNLQIRETSLDTKSVSEGHLKRNIVVKTVEMRDGEVRRDLGPVRLWLAPGILKARPWRKAWGWHIEGSQQLPVAPQGILEESKETECNSVSSVPP

SEQ ID NO: 28968 - protein, 326 aa, Homo sapiens
  ENSP00000492832
YQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRETSLDTKSVSEGHLKRNIVVKTVEMRDGEAAPASEPLGLLLLNPSKPLPHV

SEQ ID NO: 28969 - protein, 75 aa, Homo sapiens
  ENSP00000467530
  MOD_RES (1)..(1): Any amino acid
XALDIEIATYRKLLEGEENRITIPVQTFSNLQIRGGKSTKDGENHKVTRYLKSLTIRVIPIQAHQIVNGTPPARG

SEQ ID NO: 28970 - protein, 431 aa, Homo sapiens
  ENSP00000403962
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGGKSTKDGENHKVTRYLKSLTIRVIPIQAHQIVNGTPPARG

SEQ ID NO: 28971 - protein, 438 aa, Homo sapiens
  ENSP00000491088
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTNESLERQMREQEERHVREAASYQEALARLEEEGQSLKDEMARHLQEYQDLLNVKLALDIEIATYRKLLEGEENRITIPVQTFSNLQIRGQYSRASWEGHWSPAPSSRACRLLQTGTEDQGKGIQLSLGAFVTLQRS

SEQ ID NO: 28972 - protein, 29 aa, Homo sapiens
  ENSP00000492156
  MOD_RES (1)..(1): Any amino acid
XYQDLLNVKLALDIEIATYRKLLEGEENR

SEQ ID NO: 28973 - protein, 248 aa, Homo sapiens
  ENSP00000465320
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEYQDLLNVKLALDIEIATYRKLLEGEENRITIPVQTFSNLQI

SEQ ID NO: 28974 - protein, 334 aa, Homo sapiens
  ENSP00000468500
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEADEATLARLDLERKIESLEEEIRFLRKIHEEEVRELQEQLARQQVHVELDVAKPDLTAALKEIRTQYEAMASSNMHEAEEWYRSKFADLTDAAARNAELLRQAKHEANDYRRQLQSLTCDLESLRGTEYQDLLNVKLALDIEIATYRKLLEGEENRITI

SEQ ID NO: 28975 - protein, 179 aa, Homo sapiens
  ENSP00000366189
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKKQMKPPWPVWIWRGRLSRWRRRSGS

SEQ ID NO: 28976 - protein, 57 aa, Homo sapiens
  ENSP00000465565
MASSNMHEAEEWYRSKFADLTDAAARNAELLRQAKHEANDYRRQLQSLTCDLESLRG

SEQ ID NO: 28977 - protein, 261 aa, Homo sapiens
  ENSP00000465629
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKLQDETNLRLEAENNLAAYRQEVRELQEQLARQQVHVELDVAKPDLTAALKEIRTQYEAMASSNMHEAEEWYRSKFADLTDAAARNAELLRQAKHEANDYRRQLQSLT

SEQ ID NO: 28978 - protein, 61 aa, Homo sapiens
  ENSP00000465208
MERRRITSAARRSYVSSGEMMVGGLAPGRRLGPGTRLSLARMPPPLPTRVDFSLAGALNAG

SEQ ID NO: 28979 - protein, 189 aa, Homo sapiens
  ENSP00000466163
MERRRITSAARRSYVSSGEMMVGGLAPGRRLGPGTRLSLARMPPPLPTRVDFSLAGALNAGFKETRASERAEMMELNDRFASYIEKVRFLEQQNKALAAELNQLRAKEPTKLADVYQAELRELRLRLDQLTANSARLEVERDNLAQDLATVRQKNVSPHSRLQDETNLRLEAENNLAAYRQEADEATLA

SEQ ID NO: 28980 - protein, 8 aa, Homo sapiens
  ENSP00000467106
MERRRITS

SEQ ID NO: 28981 - protein, 464 aa, Homo sapiens
  ENSP00000428518
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 28982 - protein, 62 aa, Homo sapiens
  ENSP00000306654
MILANVFCLFFFLGPGPLLRRNGVQREKTCSYIQGRMMPEFSLGYEEGCPTESPWCALAKWV

SEQ ID NO: 28983 - protein, 464 aa, Homo sapiens; identical to SEQ ID NO: 28981
  ENSP00000429445

SEQ ID NO: 28984 - protein, 331 aa, Homo sapiens
  ENSP00000429206
MILANVFCLFFFLGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 28985 - protein, 359 aa, Homo sapiens
  ENSP00000429979
MILANVFCLFFFLGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 28986 - protein, 264 aa, Homo sapiens
  ENSP00000428721
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLC

SEQ ID NO: 28987 - protein, 74 aa, Homo sapiens
  ENSP00000430622
MLANKECQAALEVLQESPLYDCRCKRGMKKELQCLQIYWSIHLGLTEGEEFYEASPYEPVTSRLSDIFRLASIF

SEQ ID NO: 28988 - protein, 345 aa, Homo sapiens
  ENSP00000361207
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 28989 - protein, 638 aa, Homo sapiens
  ENSP00000230882
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 28990 - protein, 62 aa, Homo sapiens
  ENSP00000426739
MDLWQLLLTLALAGSSDAFSGSEATAAILSRAPWSLQSVNPGLKTRWGPCSHIKKMESYMQA

SEQ ID NO: 28991 - protein, 85 aa, Homo sapiens
  ENSP00000422333
MDLWQLLLTLALAGSSDAFSGSEATAAILSRAPWSLQSVNPGLKTRTLKNGLKNGKNALIMFLLGKTAVTLIHRLPPSGYLIVSS

SEQ ID NO: 28992 - protein, 638 aa, Homo sapiens; identical to SEQ ID NO: 28989
  ENSP00000478291

SEQ ID NO: 28993 - protein, 638 aa, Homo sapiens; identical to SEQ ID NO: 28989
  ENSP00000482373

SEQ ID NO: 28994 - protein, 616 aa, Homo sapiens
  ENSP00000350335
MDLWQLLLTLALAGSSDAFSGSEDSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 28995 - protein, 638 aa, Homo sapiens; identical to SEQ ID NO: 28989
  ENSP00000442206

SEQ ID NO: 28996 - protein, 638 aa, Homo sapiens; identical to SEQ ID NO: 28989
  ENSP00000478332

SEQ ID NO: 28997 - protein, 295 aa, Homo sapiens
  ENSP00000483926
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRKEN

SEQ ID NO: 28998 - protein, 645 aa, Homo sapiens
  ENSP00000483403
MNWGPTGMDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 28999 - protein, 638 aa, Homo sapiens; identical to SEQ ID NO: 28989
  ENSP00000479846

SEQ ID NO: 29000 - protein, 315 aa, Homo sapiens
  ENSP00000359795
MPLKLRGKKKAKSKETAGLVEGEPTGAGGGSLSASRAPARRLVFHAQLAHGSATGRVEGFSSIQELYAQIAGAFEISPSEILYCTLNTPKIDMERLLGGQLGLEDFIFAHVKGIEKEVNVYKSEDSLGLTITDNGVGYAFIKRIKDGGVIDSVKTICVGDHIESINGENIVGWRHYDVAKKLKELKKEELFTMKLIEPKKAFEIELRSKAGKSSGEKIGCGRATLRLRSKGPATVEEMPSETKAKAIEKIDDVLELYMGIRDIDLATTMFEAGKDKVNPDEFAVALDETLGDFAFPDEFVFDVWGVIGDAKRRGL

SEQ ID NO: 29001 - protein, 466 aa, Homo sapiens
  ENSP00000467494
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 29002 - protein, 419 aa, Homo sapiens
  ENSP00000263281
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVGRDPAAAPALWRQRGVRRRL

SEQ ID NO: 29003 - protein, 430 aa, Homo sapiens
  ENSP00000305321
MTTSPILQLLLRLSLCGLLLQRAETGSKGQTAGELYQRWERYRRECQETLAAAEPPSVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 29004 - protein, 265 aa, Homo sapiens
  ENSP00000467342
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWD

SEQ ID NO: 29005 - protein, 17 aa, Homo sapiens
  ENSP00000465385
MYVCWDYAAPNATARAS

SEQ ID NO: 29006 - protein, 382 aa, Homo sapiens
  ENSP00000282561
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 29007 - protein, 283 aa, Homo sapiens
  ENSP00000363141
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 29008 - protein, 283 aa, Homo sapiens; identical to SEQ ID NO: 29007
  ENSP00000363134

SEQ ID NO: 29009 - protein, 84 aa, Homo sapiens
  ENSP00000407223
MNWTGLYTLLSGVNRHSTAIGRVWLSVIFIFRIMVLVVAAESVWGDEKSSFICNTLQPGCNSVCYDQFFPISHVRLWSLQLILV

SEQ ID NO: 29010 - protein, 283 aa, Homo sapiens; identical to SEQ ID NO: 29007
  ENSP00000354900

SEQ ID NO: 29011 - protein, 266 aa, Homo sapiens
  ENSP00000345868
MNWAFLQGLLSGVNKYSTVLSRIWLSVVFIFRVLVYVVAAEEVWDDEQKDFVCNTKQPGCPNVCYDEFFPVSHVRLWALQLILVTCPSLLVVMHVAYREERERKHHLKHGPNAPSLYDNLSKKRGGLWWTYLLSLIFKAAVDAGFLYIFHRLYKDYDMPRVVACSVEPCPHTVDCYISRPTEKKVFTYFMVTTAAICILLNLSEVFYLVGKRCMEIFGPRHRRPRCRECLPDTCPPYVLSQGGHPEDGNSVLMKAGSAPVDAGGYP

SEQ ID NO: 29012 - protein, 261 aa, Homo sapiens
  ENSP00000241124
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 29013 - protein, 261 aa, Homo sapiens; identical to SEQ ID NO: 29012
  ENSP00000382939

SEQ ID NO: 29014 - protein, 261 aa, Homo sapiens; identical to SEQ ID NO: 29012
  ENSP00000382938

SEQ ID NO: 29015 - protein, 261 aa, Homo sapiens; identical to SEQ ID NO: 29012
  ENSP00000348521

SEQ ID NO: 29016 - protein, 261 aa, Homo sapiens; identical to SEQ ID NO: 29012
  ENSP00000489698

SEQ ID NO: 29017 - protein, 439 aa, Homo sapiens
  ENSP00000355675
MTNMSWSFLTRLLEEIHNHSTFVGKVWLTVLVVFRIVLTAVGGEAIYSDEQAKFTCNTRQPGCDNVCYDAFAPLSHVRFWVFQIVVISTPSVMYLGYAVHRLARASEQERRRALRRRPGPRRAPRAHLPPPHAGWPEPADLGEEEPMLGLGEEEEEEETGAAEGAGEEAEEAGAEEACTKAVGADGKAAGTPGPTGQHDGRRRIQREGLMRVYVAQLVARAAFEVAFLVGQYLLYGFEVRPFFPCSRQPCPHVVDCFVSRPTEKTVFLLVMYVVSCLCLLLNLCEMAHLGLGSAQDAVRGRRGPPASAPAPAPRPPPCAFPAAAAGLACPPDYSLVVRAAERARAHDQNLANLALQALRDGAAAGDRDRDSSPCVGLPAASRGPPRAGAPASRTGSATSAGTVGEQGRPGTHERPGAKPRAGSEKGSASSRDGKTTVWI

SEQ ID NO: 29018 - protein, 279 aa, Homo sapiens
  ENSP00000325775
MCGRFLRRLLAEESRRSTPVGRLLLPVLLGFRLVLLAASGPGVYGDEQSEFVCHTQQPGCKAACFDAFHPLSPLRFWVFQVILVAVPSALYMGFTLYHVIWHWELSGKGKEEETLIQGREGNTDVPGAGSLRLLWAYVAQLGARLVLEGAALGLQYHLYGFQMPSSFACRREPCLGSITCNLSRPSEKTIFLKTMFGVSGFCLLFTFLELVLLGLGRWWRTWKHKSSSSKYFLTSESTRRHKKATDSLPVVETKEQFQEAVPGRSLAQEKQRPVGPRDA

SEQ ID NO: 29019 - protein, 321 aa, Homo sapiens
  ENSP00000290374
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 29020 - protein, 542 aa, Homo sapiens
  ENSP00000265113
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 29021 - protein, 101 aa, Homo sapiens
  ENSP00000427203
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLII

SEQ ID NO: 29022 - protein, 106 aa, Homo sapiens
  ENSP00000424986
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVT

SEQ ID NO: 29023 - protein, 106 aa, Homo sapiens; identical to SEQ ID NO: 29022
  ENSP00000420992

SEQ ID NO: 29024 - protein, 430 aa, Homo sapiens
  ENSP00000483657
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 29025 - protein, 497 aa, Homo sapiens
  ENSP00000371343
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITIRDRLRTTTNVLGDSLGAGIVEHLSRHELKNRDVEMGNSVIEENEMKKPYQLIAQDNETEKPIDSETKM

SEQ ID NO: 29026 - protein, 496 aa, Homo sapiens
  ENSP00000477672
MTKSNGEEPKMGGRMERFQQGVRKRTLLAKKKVQNITKEDVKSYLFRNAFVLLTVTAVIVGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 29027 - protein, 542 aa, Homo sapiens; identical to SEQ ID NO: 29020
  ENSP00000265113

SEQ ID NO: 29028 - protein, 101 aa, Homo sapiens; identical to SEQ ID NO: 29021
  ENSP00000427203

SEQ ID NO: 29029 - protein, 106 aa, Homo sapiens; identical to SEQ ID NO: 29022
  ENSP00000424986

SEQ ID NO: 29030 - protein, 106 aa, Homo sapiens; identical to SEQ ID NO: 29022
  ENSP00000420992

SEQ ID NO: 29031 - protein, 430 aa, Homo sapiens; identical to SEQ ID NO: 29024
  ENSP00000483657

SEQ ID NO: 29032 - protein, 497 aa, Homo sapiens; identical to SEQ ID NO: 29025
  ENSP00000371343

SEQ ID NO: 29033 - protein, 496 aa, Homo sapiens; identical to SEQ ID NO: 29026
  ENSP00000477672

SEQ ID NO: 29034 - protein, 313 aa, Homo sapiens
  ENSP00000374537
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQGASIDAGLLSDASQAATSSSL

SEQ ID NO: 29035 - protein, 653 aa, Homo sapiens
  ENSP00000396615
MKSPPLLSPCLSWKRMAGIFFLPFISSGFAPRFKQEENFMLGRAHPSQPRFNWSHLTPLELKNRSVGLGTESTGRGKPHFTLEGHKFLIFGGSIHYFRVPREYWRDRLLKLKACGFNTVTTYVPWNLHEPERGKFDFSGNLDLEAFVLMAAEIGLWVILRPGRYICSEMDLGGLPSWLLQDPRLLLRTTNKSFIEAVEKYFDHLIPRVIPLQYRQAGPVIAVQVENEYGSFNKDKTYMPYLHKALLRRGIVELLLTSDGEKHVLSGHTKGVLAAINLQKLHQDTFNQLHKVQRDKPLLIMEYWVGWFDRWGDKHHVKDAKEVEHAVSEFIKYEISFNVYMFHGGTNFGFMNGATYFGKHSGIVTSYDYDAVLTEAGDYTEKYLKLQKLFQSVSATPLPRVPKLPPKAVYPPVRPSLYLPLWDALSYLNEPVRSRQPVNMENLPINNGSGQSYGLVLYEKSICSGGRLRAHAHDVAQVFLDETMIGILNENNKDLHIPELRDCRYLRILVENQGRVNFSWQIQNEQKGITGSVSINNSSLEGFTIYSLEMKMSFFERLRSATWKPVPDSHQGPAFYCGTLKAGPSPKDTFLSLLNWNYGFVFINGRNLGRYWNIGPQKTLYLPGVWLHPEDNEVILFEKMMSGSDIKSTDKPTL

SEQ ID NO: 29036 - protein, 186 aa, Homo sapiens
  ENSP00000397929
  MOD_RES (1)..(1): Any amino acid
XLKMQRVEHAVSEFIKYEISFNVYMFHGGTNFGFMNGATYFGKHSGIVTSYDYDAVLTEAGDYTEKYLKLQKLFQSVSATPLPRVPKLPPKAVYPPVRPSLYLPLWDALSYLNEPVRSRQPVNMENLPINNGSGQSYGLVLYEKSICSGGRLRAHAHDVAQVFLDETMIGILNENNKDLHIPELRE

SEQ ID NO: 29037 - protein, 1020 aa, Homo sapiens
  ENSP00000370737
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNATLILSEGLKRAGHQLQHDLFFDTLKIQCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 29038 - protein, 64 aa, Homo sapiens
  ENSP00000491487
  MOD_RES (1)..(1): Any amino acid
XSLTCVTSSHWDRPYSREVAAFPLTESRSVAQAGVQWHDPGFTPFSYLSLPLGLQAPATMPGPS

SEQ ID NO: 29039 - protein, 254 aa, Homo sapiens
  ENSP00000491312
MGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 29040 - protein, 420 aa, Homo sapiens
  ENSP00000491369
MKARRPNRDPFLLVFASGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 29041 - protein, 388 aa, Homo sapiens
  ENSP00000491932
MKARRPNRDPFLLVFASGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGFHAPTMSWPVAGTLMVEPTESEDKAELDRFCDAMISIRQEIADIEEGRIDPRVNPLKMSPHSLTCVTSSHWDRPYSREVAAFPLPFVKPENKFWPTIARIDDIYGDQHLVCTCPPMEVYESPFSEQKRASS

SEQ ID NO: 29042 - protein, 106 aa, Homo sapiens
  ENSP00000491895
MKARRPNRDPFLLVFASGAQGEYAGLATIRAYLNQKGEGHRTVCLIPKSAHGTNPASAHMAGMKIQPVEVDKYGNIDAVHLKAMVLVFSLADGRGRDGECWWGSGT

SEQ ID NO: 29043 - protein, 103 aa, Homo sapiens
  ENSP00000491209
  MOD_RES (1)..(1): Any amino acid
XGVLTELKLPCEMDFSGKDVSGVLFQYPDTEGKVEDFTELVERAHQSGRCHWERSVSSCSSNQGATHSERQGYQQHLYSSGPLGEYGCHVCNLPWFPWAGAYC

SEQ ID NO: 29044 - protein, 164 aa, Homo sapiens
  ENSP00000491101
MDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFAIYHGSHGLEHIARRVHNAT

SEQ ID NO: 29045 - protein, 140 aa, Homo sapiens
  ENSP00000491161
MGWRPGRGAPHFLGENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAK

SEQ ID NO: 29046 - protein, 55 aa, Homo sapiens
  ENSP00000491392
MGYYNCSVPQTILRNLLENSGWITQYTPYQPEVSQGRLESLLNYQTMVCDITGLD

SEQ ID NO: 29047 - protein, 551 aa, Homo sapiens
  ENSP00000335196
MARGAEGGRGDAGWGLRGALAAVALLSALNAAGTVFALCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 29048 - protein, 151 aa, Homo sapiens
  ENSP00000484633
  MOD_RES (1)..(1): Any amino acid
XCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIFGNSSN

SEQ ID NO: 29049 - protein, 427 aa, Homo sapiens
  ENSP00000379681
MVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIPNDDTLVGKADEKASEHHSPQAESMITSIGNPVQVLKVTETFGTWIRESANKSDDRIWVTEHFSGIMVKEFKDQPSLLNGSYTFIHLPYYFHGCGHVVYNNSLYYHKGGSNTLVRFEFGQETSQTLKLENALYFDRKYLFANSKTYFNLAVDEKGLWIIYASSVDGSSILVAQLDERTFSVVQHVNTTYPKSKAGNAFIARGILYVTDTKDMRVTFAFDLLGGKQINANFDLRTSQSVLAMLAYNMRDQHLYSWEDGHLMLYPVQFLSTTLNQ

SEQ ID NO: 29050 - protein, 165 aa, Homo sapiens
  ENSP00000453433
MTLSPLQIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGSRRAKGPRQPSMFNGQCPGETCAIP

SEQ ID NO: 29051 - protein, 427 aa, Homo sapiens; identical to SEQ ID NO: 29049
  ENSP00000479249

SEQ ID NO: 29052 - protein, 175 aa, Homo sapiens
  ENSP00000436671
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKC

SEQ ID NO: 29053 - protein, 1106 aa, Homo sapiens
  ENSP00000228682
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 29054 - protein, 129 aa, Homo sapiens
  ENSP00000434421
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTM

SEQ ID NO: 29055 - protein, 1065 aa, Homo sapiens
  ENSP00000434408
MFNSMTPPPISSYGEPCCLRPLPSQGAPSVGTEVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 29056 - protein, 978 aa, Homo sapiens
  ENSP00000437607
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 29057 - protein, 1065 aa, Homo sapiens; identical to SEQ ID NO: 29055
  ENSP00000441006

SEQ ID NO: 29058 - protein, 82 aa, Homo sapiens
  ENSP00000398992
METSASATASEKQEAKSGILEAAGFPDPGKKASPLVVAAAAAAAVAAQGVPQHLLPPFHAPLPIDMRHQEGRYHYEPHSVHG

SEQ ID NO: 29059 - protein, 67 aa, Homo sapiens
  ENSP00000400593
METSASATASEKQEAKSGILEAAGFPDPGKKASPLVVAAAAAAAVAAQGAQPSPSPTPSTPWPTSRF

SEQ ID NO: 29060 - protein, 67 aa, Homo sapiens; identical to SEQ ID NO: 29059
  ENSP00000403715

SEQ ID NO: 29061 - protein, 67 aa, Homo sapiens; identical to SEQ ID NO: 29059
  ENSP00000397488

SEQ ID NO: 29062 - protein, 67 aa, Homo sapiens; identical to SEQ ID NO: 29059
  ENSP00000344473

SEQ ID NO: 29063 - protein, 1586 aa, Homo sapiens
  ENSP00000390436
METSASATASEKQEAKSGILEAAGFPDPGKKASPLVVAAAAAAAVAAQGVPQHLLPPFHAPLPIDMRHQEGRYHYEPHSVHGVHGPPALSGSPVISDISLIRLSPHPAGPGESPFNAPHPYVNPHMEHYLRSVHSSPTLSMISAARGLSPADVAQEHLKERGLFGLPAPGTTPSDYYHQMTLVAGHPAPYGDLLMQSGGAASAPHLHDYLNPVDVSRFSSPRVTPRLSRKRALSISPLSDASLDLQRMIRTSPNSLVAYINNSRSSSAASGSYGHLSAGALSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDALASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 29064 - protein, 67 aa, Homo sapiens; identical to SEQ ID NO: 29059
  ENSP00000415773

SEQ ID NO: 29065 - protein, 176 aa, Homo sapiens
  ENSP00000441454
ASEKQEAKSGILEAAGFPDPGKKASPLVVAAAAAAAVAAQGVPQHLLPPFHAPLPIDMRHQEGRYHYEPHSVHGVHGVPFLQPAGDAPPEPQAGAVHLPTLRRQPGPAADDPHLTQLASGLHQQLPKQLGGQRFLRASVSGCPQPSLHLPPPHQPRGLPADSEPAEGSGVSLWTHT

SEQ ID NO: 29066 - protein, 56 aa, Homo sapiens
  ENSP00000402383
ASEKQEAKSGILEAAGFPDPGKKASPLVVAAAAAAAVAAQGGPLPSAAALSSLTSP

SEQ ID NO: 29067 - protein, 1586 aa, Homo sapiens; identical to SEQ ID NO: 29063
  ENSP00000354586

SEQ ID NO: 29068 - protein, 1580 aa, Homo sapiens
  ENSP00000379258
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHRNPTAASESPFSPPHPYINPYMDYIRSLHSSPSLSMISATRGLSPTDAPHAGVSPAEYYHQMALLTGQRSPYADIIPSAATAGTGAIHMEYLHAMDSTRFSSPRLSARPSRKRTLSISPLSDHSFDLQTMIRTSPNSLVTILNNSRSSSSASGSYGHLSASAISPALSFTYSSAPVSLHMHQQILSRQQSLGSAFGHSPPLIHPAPTFPTQRPIPGIPTVLNPVQVSSGPSESSQNKPTSESAVSSTGDPMHNKRSKIKPDEDLPSPGARGQQEQPEGTTLVKEEGDKDESKQEPEVIYETNCHWEGCAREFDTQEQLVHHINNDHIHGEKKEFVCRWLDCSREQKPFKAQYMLVVHMRRHTGEKPHKCTFEGCTKAYSRLENLKTHLRSHTGEKPYVCEHEGCNKAFSNASDRAKHQNRTHSNEKPYVCKIPGCTKRYTDPSSLRKHVKTVHGPEAHVTKKQRGDIHPRPPPPRDSGSHSQSRSPGRPTQGALGEQQDLSNTTSKREECLQVKTVKAEKPMTSQPSPGGQSSCSSQQSPISNYSNSGLELPLTDGGSIGDLSAIDETPIMDSTISTATTALALQARRNPAGTKWMEHVKLERLKQVNGMFPRLNPILPPKAPAVSPLIGNGTQSNNTCSLGGPMTLLPGRSDLSGVDVTMLNMLNRRDSSASTISSAYLSSRRSSGISPCFSSRRSSEASQAEGRPQNVSVADSYDPISTDASRRSSEASQSDGLPSLLSLTPAQQYRLKAKYAAATGGPPPTPLPNMERMSLKTRLALLGDALEPGVALPPVHAPRRCSDGGAHGYGRRHLQPHDAPGHGVRRASDPVRTGSEGLALPRVPRFSSLSSCNPPAMATSAEKRSLVLQNYTRPEGGQSRNFHSSPCPPSITENVTLESLTMDADANLNDEDFLPDDVVQYLNSQNQAGYEQHFPSALPDDSKVPHGPGDFDAPGLPDSHAGQQFHALEQPCPEGSKTDLPIQWNEVSSGSADLSSSKLKCGPRPAVPQTRAFGFCNGMVVHPQNPLRSGPAGGYQTLGENSNPYGGPEHLMLHNSPGSGTSGNAFHEQPCKAPQYGNCLNRQPVAPGALDGACGAGIQASKLKSTPMQGSGGQLNFGLPVAPNESAGSMVNGMQNQDPVGQGYLAHQLLGDSMQHPGAGRPGQQMLGQISATSHINIYQGPESCLPGAHGMGSQPSSLAVVRGYQPCASFGGSRRQAMPRDSLALQSGQLSDTSQTCRVNGIKMEMKGQPHPLCSNLQNYSGQFYDQTVGFSQQDTKAGSFSISDASCLLQGTSAKNSELLSPGANQVTSTVDSLDSHDLEGVQIDFDAIIDDGDHSSLMSGALSPSIIQNLSHSSSRLTTPRASLPFPALSMSTTNMAIGDMSSLLTSLAEESKFLAVMQ

SEQ ID NO: 29069 - protein, 180 aa, Homo sapiens
  ENSP00000406135
MEAQSHSSTTTEKKKVENSIVKCSTRTDVSEKAVASSTTSNEDESPGQTYHRERRNAITMQPQNVQGLSKVSEEPSTSSDERASLIKKEIHGSLPHVAEPSVPYRGTVFAMDPRNGYMEPHYHPPHLFPAFHPPVPIDARHHEGRYHYDPSPIPPLHMTSALSSSPTYPDLPFIRISPHR

SEQ ID NO: 29070 - protein, 96 aa, Homo sapiens
  ENSP00000407963
MEAQSHSSTTTEKKKVENSIVKCSTRTDVSEKAVASSTTSNGNHLEAQARGWTRRIGCIRAVHPCCCTNDSATDPLGWATLKGGSSKECVQTHTFT

SEQ ID NO: 29071 - protein, 266 aa, Homo sapiens
  ENSP00000266659
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 29072 - protein, 148 aa, Homo sapiens
  ENSP00000440595
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQRELPNLAI

SEQ ID NO: 29073 - protein, 238 aa, Homo sapiens
  ENSP00000391144
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVSQERGRDPNPKRGFLNLARENPGLFGQIVTKLAAQFNFALKFLALTLFPMEHILYATTDQEGITQLGHIREEPPAVPAPIMTSVWTISVLTDSETKS

SEQ ID NO: 29074 - protein, 89 aa, Homo sapiens
  ENSP00000448008
MTKSRTMTSRLGYAKKSVATTLRLFGQIVTKLAAQFNFALKFLALTLFPMEHILYATTDQEGITQLGHIREEPPAVPAPIMTSVWTISV

SEQ ID NO: 29075 - protein, 128 aa, Homo sapiens
  ENSP00000367195
MGKSASKQFHNEVLKAHNEYRQKHGVPPLKLCKNLNREAQQYSEALASTRILKHSPESSRGQCGENLAWASYDQTGHFTAMVWKNTKKMGVGKASASDGSSFVVARYFPAGNVVNEGFFEENVLPPKK

SEQ ID NO: 29076 - protein, 154 aa, Homo sapiens
  ENSP00000367196
MGKSASKQFHNEVLKAHNEYRQKHGVPPLKLCKNLNREAQQYSEALASTRILKHSPESSRGQCGENLAWASYDQTGKEVADRWYSEIKNYNFQQPGFTSGTGHFTAMVWKNTKKMGVGKASASDGSSFVVARYFPAGNVVNEGFFEENVLPPKK

SEQ ID NO: 29077 - protein, 72 aa, Homo sapiens
  ENSP00000478768
MVRNPALPDLAVSLVRRKPGHFTAMVWKNTKKMGVGKASASDGSSFVVARYFPAGNVVNEGFFEENVLPPKK

SEQ ID NO: 29078 - protein, 62 aa, Homo sapiens
  ENSP00000379857
MGKSASKQFHNEVLKAHNEYRQKHGVPPLKLCKNLNREAQQTLHGHGMEEHQEDGRGEGVRK

SEQ ID NO: 29079 - protein, 620 aa, Homo sapiens
  ENSP00000309653
MAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 29080 - protein, 795 aa, Homo sapiens
  ENSP00000486112
MHCEVAEAHSDKRPKEAPGAPGPDRGPASLGAHMAFRVTVSGGGCGDRGPRDLLARPPAPPPRAHDLLRPRSPRDYGPSKAAAAGKVNGSYGHRTPGSEKSLLDLDLAEGPGPTCCQGLFLPAGSPPPRAHPQACERLLHFPHPDRSPRPQATYVNGSLPTTQHIKQESLPDYQAMAEARTSLSAHCRGPLATGLHPDLDLPGRSLATPAPSCYLLGSEPSSGLGLQPETHLPEGSLKRCCVLGLPPTSPASSSPCASSDVTSIIRSSQTSLVTCVNGLRSPPLTGDLGGPSKRARPGPASTDSHEGSLQLEACRKASFLKQEPADEFSELFGPHQQGLPPPYPLSQLPPGPSLGGLGLGLAGRVVAGRQACRWVDCCAAYEQQEELVRHIEKSHIDQRKGEDFTCFWAGCVRRYKPFNARYKLLIHMRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 29081 - protein, 775 aa, Homo sapiens
  ENSP00000325494
MMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 29082 - protein, 930 aa, Homo sapiens
  ENSP00000371398
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 29083 - protein, 89 aa, Homo sapiens
  ENSP00000418671
MMVQRLGLISPPASQVSTACNQISPSLQRAMNAANLNIPPSDTRSLISRESLASTTLSLTESQSASSMKQEWSQGYRALPSLSNHGSQN

SEQ ID NO: 29084 - protein, 89 aa, Homo sapiens; identical to SEQ ID NO: 29083
  ENSP00000418995

SEQ ID NO: 29085 - protein, 89 aa, Homo sapiens; identical to SEQ ID NO: 29083
  ENSP00000418005

SEQ ID NO: 29086 - protein, 244 aa, Homo sapiens
  ENSP00000417883
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQN

SEQ ID NO: 29087 - protein, 142 aa, Homo sapiens
  ENSP00000419914
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGPLFRVSLWRPRP

SEQ ID NO: 29088 - protein, 244 aa, Homo sapiens; identical to SEQ ID NO: 29086
  ENSP00000417794

SEQ ID NO: 29089 - protein, 373 aa, Homo sapiens
  ENSP00000458242
MYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 29090 - protein, 553 aa, Homo sapiens
  ENSP00000262441
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 29091 - protein, 93 aa, Homo sapiens
  ENSP00000404471
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSG

SEQ ID NO: 29092 - protein, 118 aa, Homo sapiens
  ENSP00000303605
MYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERR

SEQ ID NO: 29093 - protein, 449 aa, Homo sapiens
  ENSP00000274576
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 29094 - protein, 37 aa, Homo sapiens
  ENSP00000430595
MYSFNTLRLYLWETIVFFRSPSERELQHFHQQLWFHC

SEQ ID NO: 29095 - protein, 457 aa, Homo sapiens
  ENSP00000411593
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKSPMLNLFQEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 29096 - protein, 558 aa, Homo sapiens
  ENSP00000277865
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 29097 - protein, 373 aa, Homo sapiens
  ENSP00000356537
MTTSASSHLNKGIKQVYMSLPQGEKVQAMYIWIDGTGEGLRCKTRTLDSEPKCVEELPEWNFDGSSTLQSEGSNSDMYLVPAAMFRDPFRKDPNKLVLCEVFKYNRRPAETNLRHTCKRIMDMVSNQHPWFGMEQEYTLMGTDGHPFGWPSNGFPGPQGPYYCGVGADRAYGRDIVEAHYRACLYAGVKIAGTNAEVMPAQWEFQIGPCEGISMGDHLWVARFILHRVCEDFGVIATFDPKPIPGNWNGAGCHTNFSTKAMREENGLKYIEEAIEKLSKRHQYHIRAYDPKGGLDNARRLTGFHETSNINDFSAGVANRSASIRIPRTVGQEKKGYFEDRRPSANCDPFSVTEALIRTCLLNETGDEPFQYKN

SEQ ID NO: 29098 - protein, 373 aa, Homo sapiens; identical to SEQ ID NO: 29097
  ENSP00000344958

SEQ ID NO: 29099 - protein, 373 aa, Homo sapiens; identical to SEQ ID NO: 29097
  ENSP00000307900

SEQ ID NO: 29100 - protein, 373 aa, Homo sapiens; identical to SEQ ID NO: 29097
  ENSP00000398320

SEQ ID NO: 29101 - protein, 329 aa, Homo sapiens
  ENSP00000373575
MIRNSDYKNFVCCAVCNKIIPPAPFGKTFKRIHEYKPLKTRFYTHKDILDIGANILKKEEQFQEDILREHIAKAEAEVWAQANERQKQAVEKALEEANDRHKIEIQILKEEHQKDLQEVTAKTKTEMYQNMDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 29102 - protein, 199 aa, Homo sapiens
  ENSP00000477323
MDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 29103 - protein, 698 aa, Homo sapiens
  ENSP00000385834
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCHLAQVPSHTVVARSMGGKEDLIWELLNQAQEHFGKDKSKEFQLFSSPHGKDLLFKDSAHGFLKVPPRMDAKMYLGYEYVTAIRNLREGTCPEAPTDECKPVKWCALSHHERLKCDEWSVNSVGKIECVSAETTEDCIAKIMNGEADAMSLDGGFVYIAGKCGLVPVLAENYNKSDNCEDTPEAGYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGGKNPDPWAKNLNEKDYELLCLDGTRKPVEEYANCHLARAPNHAVVTRKDKEACVHKILRQQQHLFGSNVTDCSGNFCLFRSETKDLLFRDDTVCLAKLHDRNTYEKYLGEEYVKAVGNLRKCSTSSLLEACTFRRP

SEQ ID NO: 29104 - protein, 75 aa, Homo sapiens
  ENSP00000417468
MKSVIPSDGPSVACVKKASYLDCIRAIAANEADAVTLDAGLVYDAYLAPNNLKPVVAEFYGSKEDPQTFYYAVAV

SEQ ID NO: 29105 - protein, 115 aa, Homo sapiens
  ENSP00000401505
MRLAVGALLVCAVLGLCLAVPDKTVRWCAVSEHEATKCQSFRDHMKSVIPSDGPSVACVKKASYLDCIRAIAVSRCCLKESGRKPYFLCFQSLWNNSLLTGKRSGCCDTGCRFGV

SEQ ID NO: 29106 - protein, 120 aa, Homo sapiens
  ENSP00000418396
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDFLLCCCCGEEG

SEQ ID NO: 29107 - protein, 134 aa, Homo sapiens
  ENSP00000419338
MNQLRGKKSCHTGLGRSAGWNIPIGLLYCDLPEPRKPLEKAVANFFSGSCAPCADGTDFPQLCQLCPGCGCSTLNQYFGYSGAFKCLKDGAGDVAFVKHSTIFENLANKADRDQYELLCLDNTRKPVDEYKDCH

SEQ ID NO: 29108 - protein, 102 aa, Homo sapiens
  ENSP00000418716
MRLAVGALLVCAVLGLCLAVPDKTVRWCAVSEHEATKCQSFRDHMKSVIPSDGPFSYRRGPKYGRQGGLDLGASQPGPGTFWQRQIKRIPTIQLSSWEGPAV

SEQ ID NO: 29109 - protein, 143 aa, Homo sapiens
  ENSP00000419714
  MOD_RES (1)..(1): Any amino acid
XYFAIAVVKKSASDLTWDNLKGKKSCHTAVGRTAGWNIPMGLLYNKINHCRFDEFFSEGCAPGSKKDSSLCKLCMGSGLNLCEPNNKEGYYGYTGAFRCLVEKGDVAFVKHQTVPQNTGETIQKRRGKGAEMGYRPVSHRKKP

SEQ ID NO: 29110 - protein, 698 aa, Homo sapiens; identical to SEQ ID NO: 29103
  ENSP00000385834

SEQ ID NO: 29111 - protein, 75 aa, Homo sapiens; identical to SEQ ID NO: 29104
  ENSP00000417468

SEQ ID NO: 29112 - protein, 115 aa, Homo sapiens; identical to SEQ ID NO: 29105
  ENSP00000401505

SEQ ID NO: 29113 - protein, 120 aa, Homo sapiens; identical to SEQ ID NO: 29106
  ENSP00000418396

SEQ ID NO: 29114 - protein, 134 aa, Homo sapiens; identical to SEQ ID NO: 29107
  ENSP00000419338

SEQ ID NO: 29115 - protein, 102 aa, Homo sapiens; identical to SEQ ID NO: 29108
  ENSP00000418716

SEQ ID NO: 29116 - protein, 143 aa, Homo sapiens; identical to SEQ ID NO: 29109
  ENSP00000419714
  MOD_RES (1)..(1): Any amino acid

SEQ ID NO: 29117 - protein, 381 aa, Homo sapiens
  ENSP00000275364
MSGVVRTLSRCLLPAEAGGARERRAGSGARDAEREARRRSRDIDALLARERRAVRRLVKILLLGAGESGKSTFLKQMRIIHGREFDQKALLEFRDTIFDNILKGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 29118 - protein, 322 aa, Homo sapiens
  ENSP00000385935
MKRRMFPRPCLARMPGSRGSGSTPDGNRKCCRFEHLLIAHPGSRGSRVLVDARDKLGIPWQYSENEKHGMFLMAFENKAGLPVEPATFQLYVPALSALWRDSGIREAFSRRSEFQLGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 29119 - protein, 305 aa, Homo sapiens
  ENSP00000386054
MAPRAGLGAGPLLLRSRADWVCGGWEAALSAPPPFCTAWVERTGLVHFLREGGHGACFPLALLHPGSVVSFQMIYPLIVLPLCASWHWGLIRKGIVLFWGESVKYFLDNLDRIGQLNYFPSKQDILLARKATKGIVEHDFVIKKIPFKMVDVGGQRSQRQKWFQCFDGITSILFMVSSSEYDQVLMEDRRTNRLVESMNIFETIVNNKLFFNVSIILFLNKMDLLVEKVKTVSIKKHFPDFRGDPHRLEDVQRYLVQCFDRKRRNRSKPLFHHFTTAIDTENVRFVFHAVKDTILQENLKDIMLQ

SEQ ID NO: 29120 - protein, 77 aa, Homo sapiens
  ENSP00000391462
MKRRMFPRPCLARMPGSRGSRVLVDARDKLGIPWQYSENEKHGMFLMAFENKAGLPVEPATFQLYVPALSALWRDSG

SEQ ID NO: 29121 - protein, 458 aa, Homo sapiens
  ENSP00000334051
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 29122 - protein, 381 aa, Homo sapiens
  ENSP00000439023
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 29123 - protein, 381 aa, Homo sapiens; identical to SEQ ID NO: 29122
  ENSP00000269162

SEQ ID NO: 29124 - protein, 381 aa, Homo sapiens; identical to SEQ ID NO: 29122
  ENSP00000408489

SEQ ID NO: 29125 - protein, 179 aa, Homo sapiens
  ENSP00000467345
MRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSY

SEQ ID NO: 29126 - protein, 145 aa, Homo sapiens
  ENSP00000467709
MSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYN

SEQ ID NO: 29127 - protein, 174 aa, Homo sapiens
  ENSP00000473600
MFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 29128 - protein, 54 aa, Homo sapiens
  ENSP00000466709
  MOD_RES (1)..(1): Any amino acid
XTNKICWQKKSWQGNQKLKTISQNMQIILFLKTEHQGEAPPLADSQGHLPSRGC

SEQ ID NO: 29129 - protein, 354 aa, Homo sapiens
  ENSP00000262493
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 29130 - protein, 54 aa, Homo sapiens
  ENSP00000492271
MGCTLSAEERAALERSKAIEKNLKEDGISAAKDVKLLLLGAGESGKSTIVKQMK

SEQ ID NO: 29131 - protein, 354 aa, Homo sapiens; identical to SEQ ID NO: 29129
  ENSP00000491223

SEQ ID NO: 29132 - protein, 354 aa, Homo sapiens
  ENSP00000262494
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYTHVTCATDTNNIQFVFDAVTDVIIAKNLRGCGLY

SEQ ID NO: 29133 - protein, 84 aa, Homo sapiens
  ENSP00000477740
MGCTLSAEERAALERSKAIEKNLKEDGISAAKDVKLLLLGAGESGKSTIVKQMKYPLSFYSVPSTILSVVTEQDTQNLCPPGVF

SEQ ID NO: 29134 - protein, 104 aa, Homo sapiens
  ENSP00000492694
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKVGP

SEQ ID NO: 29135 - protein, 146 aa, Homo sapiens
  ENSP00000492677
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKLPGQPGSDWGRRLPAHRAGHPPNQGQNHWHRRNPLHIQEPPLQAV

SEQ ID NO: 29136 - protein, 61 aa, Homo sapiens
  ENSP00000491999
ALERSKAIEKNLKEDGISAAKDVKLLLLGAGESGKSTIVKQMKQYVLSVWKLLRFCVHLEV

SEQ ID NO: 29137 - protein, 76 aa, Homo sapiens
  ENSP00000491391
  MOD_RES (1)..(1): Any amino acid
XSLAAIVRAMDTLGIEYGDKERKADAKMVCDVVSRMEDTEPFSAELLSAMMRLWGDSGIQECFNRSREYQLNDSAK

SEQ ID NO: 29138 - protein, 195 aa, Homo sapiens
  ENSP00000457238
SRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTDCFTDSLLLTLISW

SEQ ID NO: 29139 - protein, 196 aa, Homo sapiens
  ENSP00000491137
  MOD_RES (1)..(1): Any amino acid
XLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 29140 - protein, 69 aa, Homo sapiens
  ENSP00000491143
  MOD_RES (1)..(1): Any amino acid
XGQRSERKKWIHCFEDVTAIIFCVALSGYDQVLHEDETTAPIPMKTQPPTSKHNLKAKTAHPTKKYIVT

SEQ ID NO: 29141 - protein, 142 aa, Homo sapiens
  ENSP00000491875
IHCFEDVTAIIFCVALSGYDQVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQVVFDAVTDIIIANNLRGCGLY

SEQ ID NO: 29142 - protein, 109 aa, Homo sapiens
  ENSP00000454971
QVLHEDETTNRMHESLMLFDSICNNKFFIDTSIILFLNKKDLFGEKIKKSPLTICFPEYTGPNTYEDAAAYIQAQFESKNRSPNKEIYCHMTCATDTNNIQTASRTLCC

SEQ ID NO: 29143 - protein, 340 aa, Homo sapiens [sequence omitted]

SEQ ID NO: 29144 - protein, 232 aa, Homo sapiens
  ENSP00000442002
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTALWDIETGQQKTVFVGHTGDCMSLAVSPDFNLFISGACDASAKLWDVREGTCRQTFTGHESDINAIC

SEQ ID NO: 29145 - protein, 232 aa, Homo sapiens
  ENSP00000439753
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCALWDIETGQQKTVFVGHTGDCMSLAVSPDFNLFISGACDASAKLWDVREGTCRQTFTGHESDINAI

SEQ ID NO: 29146 - protein, 339 aa, Homo sapiens
  ENSP00000414734
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTALWDIETGQQKTVFVGHTGDCMSLAVSPDFNLFISGACDASAKLWDVREGTCRQTFTGHESDINAICFFPNGEAICTGSDDASCRLFDLRADQELICFSHESIICGITSVAFSLSGRLLFAGYDDFNCNVWDSMKSERVGILSGHDNRVSCLGVTADGMAVATGSWDSFLKIWN

SEQ ID NO: 29147 - protein, 36 aa, Homo sapiens
  ENSP00000444325
MGEMEQLRQEAEQLKKQIADARKACADVTLAERDLL

SEQ ID NO: 29148 - protein, 264 aa, Homo sapiens
  ENSP00000445967
MGEMEQLRQEAEQLKKQIADARKACADVTLAELVSGLEVVGRVQMRTRRTLRGHLAKIYAMHWATDSKLLVSASQDGKLIVWDSYTTNKVHAIPLRSSWVMTCAYAPSGNFVACGGLDNMCSIYNLKSREGNVKVSRELSAHTGYLSCCRFLDDNNIVTSSGDTTCAKLWDVREGTCRQTFTGHESDINAICFFPNGEAICTGSDDASCRLFDLRADQELICFSHESIICGITSVAFSLSGRLLFAGYDDFNCNVWDSMKSERV

SEQ ID NO: 29149 - protein, 73 aa, Homo sapiens
  ENSP00000248564
MPALHIEDLPEKEKLKMEVEQLRKEVKLQRQQVSKCSEEIKNYIEERSGEDPLVKGIPEDKNPFKEKGSCVIS

SEQ ID NO: 29150 - protein, 72 aa, Homo sapiens
  ENSP00000360021
MSSKTASTNNIAQARRTVQQLRLEASIERIKVSKASADLMSYCEEHARSDPLLIGIPTSENPFKDKKTCIIL

SEQ ID NO: 29151 - protein, 67 aa, Homo sapiens
  ENSP00000248150
MEEWDVPQMKKEVESLKYQLAFQREMASKTIPELLKWIEDGIPKDPFLNPDLMKNNPWVEKGKCTIL

SEQ ID NO: 29152 - protein, 102 aa, Homo sapiens
  ENSP00000451279
MQGKLQPPMEREARDGVPSGKVFLKDLSSTPMASNNTASIAQARKLVEQLKMEANIDRIKVSKAAADLMAYCEAHAKEDPLLTPVPASENPFREKKFFCAIL

SEQ ID NO: 29153 - protein, 37 aa, Homo sapiens
  ENSP00000450904
MQGKLQPPMEREARDGVPSGKARSASEPQALGTEECF

SEQ ID NO: 29154 - protein, 110 aa, Homo sapiens
  ENSP00000450758
MVYLQAKTRIPEHRKVTQLIKCWSPDLNPVFLKDLSSTPMASNNTASIAQARKLVEQLKMEANIDRIKVSKAAADLMAYCEAHAKEDPLLTPVPASENPFREKKFFCAIL

SEQ ID NO: 29155 - protein, 52 aa, Homo sapiens
  ENSP00000450586
MASNNTASIAQARKLVEQLKMEANIDRIKSALCWSVLRRRHIIASFVCRCSL

SEQ ID NO: 29156 - protein, 71 aa, Homo sapiens
  ENSP00000334448
MASNNTASIAQARKLVEQLKMEANIDRIKVSKAAADLMAYCEAHAKEDPLLTPVPASENPFREKKFFCAIL

SEQ ID NO: 29157 - protein, 71 aa, Homo sapiens; identical to SEQ ID NO: 29156
  ENSP00000451102

SEQ ID NO: 29158 - protein, 71 aa, Homo sapiens; identical to SEQ ID NO: 29156
  ENSP00000451231

SEQ ID NO: 29159 - protein, 71 aa, Homo sapiens; identical to SEQ ID NO: 29156
  ENSP00000452014

SEQ ID NO: 29160 - protein, 71 aa, Homo sapiens; identical to SEQ ID NO: 29156
  ENSP00000451576

SEQ ID NO: 29161 - protein, 61 aa, Homo sapiens
  ENSP00000451536
MTVPLNGVIRQHKTDKPDQVFLKDLSSTPMASNNTASIAQARKLVEQLKMEANIDRIKEVH

SEQ ID NO: 29162 - protein, 71 aa, Homo sapiens; identical to SEQ ID NO: 29156
  ENSP00000484021

SEQ ID NO: 29163 - protein, 134 aa, Homo sapiens
  ENSP00000419734
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLE

SEQ ID NO: 29164 - protein, 549 aa, Homo sapiens
  ENSP00000395772
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 29165 - protein, 537 aa, Homo sapiens
  ENSP00000378278
MTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVIEASDVVLEVLDARDPLGCRCPQVEEAIVQSGQKKLVLILNKSDLVPKENLESWLNYLKKELPTVVFRASTKPKDKGKITKRVKAKKNAAPFRSEVCFGKEGLWKLLGGFQETCSKAIRVGVIGFPNVGKSSIINSLKQEQMCNVGVSMGLTRSMQVVPLDKQITIIDSPSFIVSPLNSSSALALRSPASIEVVKPMEAASAILSQADARQVVLKYTVPGYRNSLEFFTVLAQRRGMHQKGGIPNVEGAAKLLWSEWTGASLAYYCHPPTSWTPPPYFNESIVVDMKSGFNLEELEKNNAQSIRAIKGPHLANSILFQSSGLTNGIIEEKDIHEELPKRKERKQEEREDDKDSDQETVDEEVDENSSGMFAAEETGEALSEETTAGEQSTRSFILDKIIEEDDAYDFSTDYV

SEQ ID NO: 29166 - protein, 138 aa, Homo sapiens
  ENSP00000420345
MKRPKLKKASKRMTCHKRYKIQKKVREHHRKLRKEAKKRGHKKPRKDPGVPNSAPFKEALLREAELRKQRLEELKQQQKLDRQKELEKKRKLETNPDIKPSNVEPMEKEFGLCKTENKAKSGKQNSKKLYCQELKKVS

SEQ ID NO: 29167 - protein, 96 aa, Homo sapiens
  ENSP00000419895
MTCHKRYKIQKKVREHHRKLRKEAKKRGHKKPRKDPGVPNSAPFKEALLREAELRKQRLEELKQQQKLDRQKELEKKRKLETNPDIKPSNVEPMEK

SEQ ID NO: 29168 - protein, 167 aa, Homo sapiens
  ENSP00000359634
MATEVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 29169 - protein, 166 aa, Homo sapiens
  ENSP00000471396
SPQVHNLQELRRSASLATKVFIQRDYSDGTICQFQTKFPPELDSRIERQLFEETVKTLNGFYAEAEKIGGSSYLEGCLACATAYFIFLCMETHYEKVLKKISRYIQEQNEKIFAPRGLLLTDPVERGMRVIEISIYEDRCSSGSSSSGSSSGSGSSSGGGGGAGAR

SEQ ID NO: 29170 - protein, 413 aa, Homo sapiens
  ENSP00000359539
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEKRVGGVQSLGGTGALRIGADFLARWYNGTNNKNTPVYVSSPTWENHNAVFSAAGFKDIRSYRYWDAEKRGLDLQGFLNDLENAPEFSIVVLHACAHNPTGIDPTPEQWKQIASVMKHRFLFPFFDSAYQGFASGNLERDAWAIRYFVSEGFEFFCAQSFSKNFGLYNERVGNLTVVGKEPESILQVLSQMEKIVRITWSNPPAQGARIVASTLSNPELFEEWTGNVKTMADRILTMRSELRARLEALKTPGTWNHITDQIGMFSFTGLNPKQVEYLVNEKHIYLLPSGRINVSGLTTKNLDYVATSIHEAVTKIQ

SEQ ID NO: 29171 - protein, 370 aa, Homo sapiens
  ENSP00000357215
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 29172 - protein, 375 aa, Homo sapiens
  ENSP00000396441
MFPRSGPSNDEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKKKRWHHEEEKMGVLEEGGKGKEAAGSVRTEEVESRAYADPCSRRKKRQQQEEEDLNLEDRGEETFRWWNQGSREQSMQ

SEQ ID NO: 29173 - protein, 264 aa, Homo sapiens
  ENSP00000412620
MNVTPEVKSRGMKFAEEQLLKHGWTQGKGLGRKENGITQALRVTLKQDTHGVGHDPAKEFTNHWWNELFNKTAANLVVETGQMATLTSGGEKPNKDLESCSDDDNQGSKSPKILTDEMLLQACEGRTAHKAARLGITMKAKLARLEAQEQAFLARLKGQDPGAPQLQSESKPPKKKKKKRRQKEEEEATASERNDADEKHPEHAEQNIRKSKKKKRRHQEGKVSDEREGTTKGNEKEDAAGTSGLGELNSREQTNQSLRKGKKK

SEQ ID NO: 29174 - protein, 119 aa, Homo sapiens
  ENSP00000436243
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKTAQTLSRN

SEQ ID NO: 29175 - protein, 143 aa, Homo sapiens
  ENSP00000436907
MNVTPEVKSRGMKFAEEQLLKHGWTQGKGLGRKENGITQALRVTLKQDTHGVGHDPAKEFTNHWWNELFNKTAANLVVETGQDGVQIRSLSKETTRYNHPKPNLLYQKFVKWDPVTSLAVAYLDCPDPQQELRSSGSVDPAIC

SEQ ID NO: 29176 - protein, 134 aa, Homo sapiens
  ENSP00000488396
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDDNPDPGGCPSLCAGPGDWKKCGQRSA

SEQ ID NO: 29177 - protein, 579 aa, Homo sapiens
  ENSP00000292377
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 29178 - protein, 555 aa, Homo sapiens
  ENSP00000366246
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 29179 - protein, 263 aa, Homo sapiens
  ENSP00000477667
DAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 29180 - protein, 672 aa, Homo sapiens
  ENSP00000368305
MTPSQVAFEIRGTLLPGEVFAICGSCDALGNWNPQNAVALLPENDTGESMLWKATIVLSRGVSVQYRYFKGYFLEPKTIGGPCQVIVHKWETHLQPRSITPLESEIIIDDGQFGIHNGVETLDSGWLTCQTEIRLRLHYSEKPPVSITKKKLKKSRFRVKLTLEGLEEDDDDRVSPTVLHKMSNSLEISLISDNEFKCRHSQPECGYGLQPDRWTEYSIQTMEPDNLELIFDFFEEDLSEHVVQGDALPGHVGTACLLSSTIAESGKSAGILTLPIMSRNSRKTIGKVRVDYIIIKPLPGYSCDMKSSFSKYWKPRIPLDVGHRGAGNSTTTAQLAKVQENTIASLRNAASHGAAFVEFDVHLSKDFVPVVYHDLTCCLTMKKKFDADPVELFEIPVKELTFDQLQLLKLTHVTALKSKDRKESVVQEENSFSENQPFPSLKMVLESLPEDVGFNIEIKWICQQRDGMWDGNLSTYFDMNLFLDIILKTVLENSGKRRIVFSSFDADICTMVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 29181 - protein, 264 aa, Homo sapiens
  ENSP00000396720
  MOD_RES (1)..(1): Any amino acid
XCDMKSSFSKYWKPRIPLDVGHRGAGNSTTTAQLAKVQENTIASLRNAASHGAAFVEFDVHLSKDFVPVVYHDLTCCLTMKKNLWFRRKIPFQKISHFLLLRWVRQKQNKYPILFLTQGKSEIYPELMDLRSRTTPIAMSFAQFENLLGINVHTEDLLRNPSYIQEAKAKGLVIFCWGDDTNDPENRRKLKELGVNGLIYDRIYDWMPEQPNIFQVEQLERLKQELPELKSCLCPTVSRFVPSSLCGESDIHVDANGIDNVENA

SEQ ID NO: 29182 - protein, 62 aa, Homo sapiens
  ENSP00000487616
  MOD_RES (1)..(1): Any amino acid
XENTIASLRNAASHGAAFVEFDVHLSKDFVPVVYHDLTCCLTMKKLSSALQLSASCIFLPEI

SEQ ID NO: 29183 - protein, 101 aa, Homo sapiens
  ENSP00000488635
MTPSQVAFEIRGTLLPGEVFAICGSCDALGNWNPQNAVALLPENDTGESMLWKATIVLSRGVSVQYRYFKGYFLEPKKAKLLLTMDNLESTMVLKLWILDG

SEQ ID NO: 29184 - protein, 736 aa, Homo sapiens
  ENSP00000312771
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 29185 - protein, 769 aa, Homo sapiens
  ENSP00000417901
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 29186 - protein, 380 aa, Homo sapiens
  ENSP00000452220
MATEGMILTNHDHQIRVGVLTVSDSCFRNLAEDRSGINLKDLVQDPSLLGGTISAYKIVPDEIEEIKKFPTFPFCGLQKGATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRGTIIFDHCPFFSSFFSK

SEQ ID NO: 29187 - protein, 782 aa, Homo sapiens
  ENSP00000438404
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEKFPTFPFCGLQKGATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKQIRRPDESKGVASRVGSLKARLPSCSSTYSVSEVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 29188 - protein, 49 aa, Homo sapiens
  ENSP00000451935
MATEGMILTNHDHQIRVGVLTVSDSCFRNLAEDRSGINLKDLVQDPSLG

SEQ ID NO: 29189 - protein, 50 aa, Homo sapiens
  ENSP00000451056
MATEGMILTNHDHQIRVGVLTVSDSCFRNLAEDRSGINLKDLVQDPSLKP

SEQ ID NO: 29190 - protein, 49 aa, Homo sapiens; identical to SEQ ID NO: 29188
  ENSP00000451790

SEQ ID NO: 29191 - protein, 39 aa, Homo sapiens
  ENSP00000451725
MATEGMILTNHDHQIRVGVLTVGMEFHRVSQDGLDLLTL

SEQ ID NO: 29192 - protein, 280 aa, Homo sapiens
  ENSP00000450706
ETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKQIRRPDESKGVASRVGSLKVQSRCSSKENILRASHSAVDITKVARRHRMSPFPLTSMDK

SEQ ID NO: 29193 - protein, 201 aa, Homo sapiens
  ENSP00000452009
HMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARVMLSNDQKPKWKPGNS

SEQ ID NO: 29194 - protein, 60 aa, Homo sapiens
  ENSP00000450442
  MOD_RES (1)..(1): Any amino acid
XLLMLPPKTEHAKRRLTGWRLCLASRTIPCRASREVSRPNSLTAQYSWAVTGHLLFEETN

SEQ ID NO: 29195 - protein, 560 aa, Homo sapiens
  ENSP00000258733
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 29196 - protein, 572 aa, Homo sapiens
  ENSP00000371420
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 29197 - protein, 206 aa, Homo sapiens
  ENSP00000386476
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 29198 - protein, 600 aa, Homo sapiens
  ENSP00000361483
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIESHHFAQADLELLASSCPPASVSQRAGITAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 29199 - protein, 552 aa, Homo sapiens
  ENSP00000336988
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 29200 - protein, 128 aa, Homo sapiens
  ENSP00000475772
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRR

SEQ ID NO: 29201 - protein, 571 aa, Homo sapiens
  ENSP00000361487
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 29202 - protein, 600 aa, Homo sapiens; identical to SEQ ID NO: 29198
  ENSP00000483750

SEQ ID NO: 29203 - protein, 494 aa, Homo sapiens
  ENSP00000432696
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 29204 - protein, 494 aa, Homo sapiens; identical to SEQ ID NO: 29203
  ENSP00000378548

SEQ ID NO: 29205 - protein, 609 aa, Homo sapiens
  ENSP00000367125
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 29206 - protein, 529 aa, Homo sapiens
  ENSP00000356812
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29207 - protein, 397 aa, Homo sapiens
  ENSP00000356810
MVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29208 - protein, 529 aa, Homo sapiens; identical to SEQ ID NO: 29206
  ENSP00000356809

SEQ ID NO: 29209 - protein, 415 aa, Homo sapiens
  ENSP00000444348
MLVPVGWMNESYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29210 - protein, 546 aa, Homo sapiens
  ENSP00000271357
MKVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29211 - protein, 451 aa, Homo sapiens
  ENSP00000437576
MGGRRCVPGTLPMRAAPPGAKRLHVPLRAKGVGRSGHAPRLESVRTSYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29212 - protein, 549 aa, Homo sapiens
  ENSP00000441039
MSARGVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 29213 - protein, 433 aa, Homo sapiens
  ENSP00000302676
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 29214 - protein, 433 aa, Homo sapiens; identical to SEQ ID NO: 29213
  ENSP00000492841

SEQ ID NO: 29215 - protein, 381 aa, Homo sapiens
  ENSP00000367384
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 29216 - protein, 381 aa, Homo sapiens; identical to SEQ ID NO: 29215
  ENSP00000367378

SEQ ID NO: 29217 - protein, 334 aa, Homo sapiens
  ENSP00000480296
MDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 29218 - protein, 613 aa, Homo sapiens
  ENSP00000306449
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 29219 - protein, 481 aa, Homo sapiens
  ENSP00000356251
MRWLWPLAVSLAVILAVGLSRVSGGAPLHLGRHRAETQEQQSRSKRGTEDEEAKGVQQYVPEEWAEYPRPIHPAGLQPTKPLVATSPNPGKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 29220 - protein, 419 aa, Homo sapiens
  ENSP00000229955
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 29221 - protein, 396 aa, Homo sapiens
  ENSP00000267015
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 29222 - protein, 396 aa, Homo sapiens; identical to SEQ ID NO: 29221
  ENSP00000450310

SEQ ID NO: 29223 - protein, 838 aa, Homo sapiens
  ENSP00000339057
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVKQEPRFEEEVIIGSWFWAEKEASLEGGASAICESEPGTEEGAIGGSAYWAEEKSSLGAVAREEAKPESEEEAIFGSWFWDRDEACFDLNPCPVYKVSDRFRDAAEELNASSRPQTWDEVTVEFKPGLFHGVGFRSTSPFGIPEEASEMLEAKPKNLELSPEGEEQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 29224 - protein, 838 aa, Homo sapiens; identical to SEQ ID NO: 29223
  ENSP00000437872

SEQ ID NO: 29225 - protein, 838 aa, Homo sapiens; identical to SEQ ID NO: 29223
  ENSP00000437394

SEQ ID NO: 29226 - protein, 126 aa, Homo sapiens
  ENSP00000340595
MYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 29227 - protein, 150 aa, Homo sapiens
  ENSP00000462147
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQLRGRCHHTAGTMGSC

SEQ ID NO: 29228 - protein, 145 aa, Homo sapiens
  ENSP00000463813
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLA

SEQ ID NO: 29229 - protein, 153 aa, Homo sapiens
  ENSP00000462440
MQAPAHPRRKQGALPGDRPARERATQRAWLSLGPRERQALRPGPGPAIPARTGPGPAPRAASLPPPPAPRLGLELAPNAALERGRRRVPGTQPEPGLGARMAIHKALVMCLGLPLFLFPGAWAQGHVPPGCSQGLNPLYYNLCDRSGAWGIVL

SEQ ID NO: 29230 - protein, 355 aa, Homo sapiens
  ENSP00000463090
  MOD_RES (1)..(1): Any amino acid
XNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQDDDQSSSLERCPVVSPTALWCYPRPQQPVPLSLAYFSRAKLGEQSLQSRIAALTVAPDLSVLPVEVHEQNVISLQWKGSRELCGPHAALGLA

SEQ ID NO: 29231 - protein, 453 aa, Homo sapiens
  ENSP00000376405
MGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 29232 - protein, 462 aa, Homo sapiens
  ENSP00000376404
  MOD_RES (1)..(1): Any amino acid
XKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQAQSPQSKTRW

SEQ ID NO: 29233 - protein, 486 aa, Homo sapiens
  ENSP00000376403
MRGRGSQQQQPTRRQGQKLPSPSPAGKYESAQPGGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 29234 - protein, 684 aa, Homo sapiens
  ENSP00000385510
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 29235 - protein, 213 aa, Homo sapiens
  ENSP00000408664
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHY

SEQ ID NO: 29236 - protein, 75 aa, Homo sapiens
  ENSP00000401948
MEENLISMREDHSFHVRYRMEASCLELALEGERLCKSGDCRAGVSFFEAAVQVGTEDLKTLSAIYSQLGNAYFYL

SEQ ID NO: 29237 - protein, 52 aa, Homo sapiens
  ENSP00000392138
MEENLISMREDHSFHVRYRMEASCLELALEGERLCKSGDCRAGVSFFEAAVQ

SEQ ID NO: 29238 - protein, 217 aa, Homo sapiens
  ENSP00000390629
  MOD_RES (1)..(1): Any amino acid
XMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQVCLYIFFVLHTAQIPLKTLVVL

SEQ ID NO: 29239 - protein, 684 aa, Homo sapiens; identical to SEQ ID NO: 29234
  ENSP00000264126

SEQ ID NO: 29240 - protein, 78 aa, Homo sapiens
  ENSP00000450991
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQNCSG

SEQ ID NO: 29241 - protein, 190 aa, Homo sapiens
  ENSP00000374265
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 29242 - protein, 134 aa, Homo sapiens
  ENSP00000451721
FIAKSFYDLSAISLDGEKENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 29243 - protein, 78 aa, Homo sapiens
  ENSP00000451844
  MOD_RES (40)..(40): Selenocysteine
MAFIAKSFYDLSAISLDGEKVDFNTFRGRAVLIENVASLXGTTTRDFTQLNELQCRFPRRLVVLGFPCNQFGHQERQK

SEQ ID NO: 29244 - protein, 189 aa, Homo sapiens
  ENSP00000478082
MAFIAKSFYDLSAISLDGEKVDFNTFRGRAVLIENVASLGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 29245 - protein, 447 aa, Homo sapiens
  ENSP00000426120
MTRRQQVLQAKRSIQQTFQAQLMPWKSMFHGREVKPVGPDLELSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29246 - protein, 288 aa, Homo sapiens
  ENSP00000424985
MVKKRLPSSDTVFRFETPGSPRKANVEASRSSTDSPSSVFLSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQ

SEQ ID NO: 29247 - protein, 432 aa, Homo sapiens
  ENSP00000285689
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29248 - protein, 410 aa, Homo sapiens
  ENSP00000426143
MTELQQDVEDTKPAKVLGKRESKLGSAHSEAENGVEEKKKACRSPTAQSPTPSVEADSPDQKKIISLCPYLLSKSMLHSGPRYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRVDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29249 - protein, 87 aa, Homo sapiens
  ENSP00000423236
MTELQQDVEDTKPAKVLGKRESKLGSAHSEAENGVEEKKKACRSPTAQSPTPSVEADSPDQKKIISLCTRPICTFTSCFLVSQRRNH

SEQ ID NO: 29250 - protein, 87 aa, Homo sapiens
  ENSP00000421494
MTELQQDVEDTKPAKVLGKRESKLGSAHSEAENGVEEKKKACRSPTAQSPTPSVEADSPDQKKIISLCPYLLSKSMLHSGPRVKIQF

SEQ ID NO: 29251 - protein, 323 aa, Homo sapiens
  ENSP00000427596
MHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29252 - protein, 416 aa, Homo sapiens
  ENSP00000426088
MSKVKRFPFFFSSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29253 - protein, 440 aa, Homo sapiens
  ENSP00000441876
MWKTQSLRKCSGRGRANLAQPTQRLRMVWRRKRKPAGRQQPNPLPHLWRRTPQTRRKSLAYAHIFSPNLCFIQDQESKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29254 - protein, 328 aa, Homo sapiens
  ENSP00000444049
MYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 29255 - protein, 86 aa, Homo sapiens
  ENSP00000409784
MLRRLDKIRFRGHKRDDFLDLAESPNASDTECSDEIPLKVPRTSPRDSEELRDPAGPGTLIMATGVQDFNRTEFDRLNEIKGHLEI

SEQ ID NO: 29256 - protein, 33 aa, Homo sapiens
  ENSP00000408042
MLRRLDKIRFRGHKRDDFLDLAESPNASDTECS

SEQ ID NO: 29257 - protein, 578 aa, Homo sapiens
  ENSP00000385689
MLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 29258 - protein, 223 aa, Homo sapiens
  ENSP00000397501
  MOD_RES (1)..(1): Any amino acid
XEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVVLTRDLSLEGQRLPAPSKDGPSWDLGSLELSCPSWVGHH

SEQ ID NO: 29259 - protein, 101 aa, Homo sapiens
  ENSP00000385851
MPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 29260 - protein, 578 aa, Homo sapiens; identical to SEQ ID NO: 29257
  ENSP00000354313

SEQ ID NO: 29261 - protein, 536 aa, Homo sapiens
  ENSP00000385189
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 29262 - protein, 588 aa, Homo sapiens
  ENSP00000385544
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 29263 - protein, 536 aa, Homo sapiens; identical to SEQ ID NO: 29261
  ENSP00000385366

SEQ ID NO: 29264 - protein, 548 aa, Homo sapiens
  ENSP00000349818
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 29265 - protein, 536 aa, Homo sapiens; identical to SEQ ID NO: 29261
  ENSP00000385046

SEQ ID NO: 29266 - protein, 594 aa, Homo sapiens
  ENSP00000385770
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 29267 - protein, 536 aa, Homo sapiens; identical to SEQ ID NO: 29261
  ENSP00000385748

SEQ ID NO: 29268 - protein, 108 aa, Homo sapiens
  ENSP00000410920
LADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQVLGHNRSLLK

SEQ ID NO: 29269 - protein, 114 aa, Homo sapiens
  ENSP00000413023
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAV

SEQ ID NO: 29270 - protein, 594 aa, Homo sapiens; identical to SEQ ID NO: 29266
  ENSP00000381793

SEQ ID NO: 29271 - protein, 536 aa, Homo sapiens; identical to SEQ ID NO: 29261
  ENSP00000338543

SEQ ID NO: 29272 - protein, 536 aa, Homo sapiens; identical to SEQ ID NO: 29261
  ENSP00000381790

SEQ ID NO: 29273 - protein, 540 aa, Homo sapiens
  ENSP00000263915
MTTSLQDGQSAASRAAARDSPLAAQVCGAAQGRGDAHDLAPAPWLHARALLPLPDGTRGCAADRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 29274 - protein, 415 aa, Homo sapiens
  ENSP00000416786
MGRAPRAGRLPGIRRWPPRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVD

SEQ ID NO: 29275 - protein, 155 aa, Homo sapiens
  ENSP00000401702
MFSYCRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFAT

SEQ ID NO: 29276 - protein, 118 aa, Homo sapiens
  ENSP00000463416
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHSCAIPGAQVVKVYSED

SEQ ID NO: 29277 - protein, 532 aa, Homo sapiens
  ENSP00000310771
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 29278 - protein, 52 aa, Homo sapiens
  ENSP00000463126
MELDLSPPHLSSSPEDLCPAPGTPPGTPRPPDTPLPEEVCGGGSRCHSSPRV

SEQ ID NO: 29279 - protein, 532 aa, Homo sapiens; identical to SEQ ID NO: 29277
  ENSP00000377761

SEQ ID NO: 29280 - protein, 555 aa, Homo sapiens
  ENSP00000403459
MGKWRPGQGHTTGSVKPLSCSDAMELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAAIHRTQLWFHGRISREESQRLIGQQGLVDGLFLVRESQRNPQGFVLSLCHLQKVKHYLILPSEEEGRLYFSMDDGQTRFTDLLQLVEFHQLNRGILPCLLRHCCTRVAL

SEQ ID NO: 29281 - protein, 532 aa, Homo sapiens; identical to SEQ ID NO: 29277
  ENSP00000377759

SEQ ID NO: 29282 - protein, 447 aa, Homo sapiens
  ENSP00000377754
MELDLSPPHLSSSPEDLCPAPGTPPGTPRPPDTPLPEEVKRSQPLLIPTTGRKLREEERRATSLPSIPNPFPELCSPPSQSPILGGPSSARGLLPRDASRPHVVKVYSEDGACRSVEVAAGATARHVCEMLVQRAHALSDETWGLVECHPHLALERGLEDHESVVEVQAAWPVGGDSRFVFRKNFAKYELFKSSPHSLFPEKMVSSCLDAHTGISHEDLIQNFLNAGSFPEIQGFLQLRGSGRKLWKRFFCFLRRSGLYYSTKGTSKDPRHLQYVADVNESNVYVVTQGRKLYGMPTDFGFCVKPNKLRNGHKGLRIFCSEDEQSRTCWLAAFRLFKYGVQLYKNYQQAQSRHLHPSCLGSPPLRSASDNTLVAMDFSGHAGRVIENPREALSVALEEAQAWRKKTNHRLSLPMPASGTSLSAACSWSGRVSGTPRALSSLCATCRK

SEQ ID NO: 29283 - protein, 79 aa, Homo sapiens
  ENSP00000487278
MGNSYAGQLKTTRFEEVLHNSIEASLRSNNLVPRPIFSQLYLEAEQQLAALEGGSRVDNEEEEEEGEGGLETNGPPNPF

SEQ ID NO: 29284 - protein, 1949 aa, Homo sapiens
  ENSP00000370896
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 29285 - protein, 409 aa, Homo sapiens
  ENSP00000263834
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKVFVNGATQMVALGPAEPASPRSL

SEQ ID NO: 29286 - protein, 253 aa, Homo sapiens
  ENSP00000374475
MDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGSSACPGRPGDPALLWAKARGGMGAAGLGPLSLLESDVASMRVRPGPQVPPESVGLGPGPGAL

SEQ ID NO: 29287 - protein, 457 aa, Homo sapiens
  ENSP00000370892
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAHQIRNPDV

SEQ ID NO: 29288 - protein, 541 aa, Homo sapiens
  ENSP00000403886
MYGTVSCAQDWVPSRCCSSAGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHY

SEQ ID NO: 29289 - protein, 947 aa, Homo sapiens
  ENSP00000379429
MWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 29290 - protein, 1949 aa, Homo sapiens; identical to SEQ ID NO: 29284
  ENSP00000234142

SEQ ID NO: 29291 - protein, 1814 aa, Homo sapiens
  ENSP00000269218
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 29292 - protein, 1923 aa, Homo sapiens
  ENSP00000464162
MGNSYAGQLKSARFEEALHNSIEASLRCSSVVPRPIFSQLYLDPDQHPFSSADVKPKVEDLDKDLVNRYTQNGSLDFSNNLTVNEMEDDEDDEEMSDSNSPPIPYSQKPAPEGSCTTDGFCQAGKDLRLVSLCMEQIDIPAGFLLVGAKSPNLPEHILVCAVDKRFLPDDHGKNALLGFSGNCIGCGERGFRYFTEFSNHINLKLTTQPKKQKHLKYYLVRSSQGVLSKGPLICWKECRSRQSSASCHSIKPSSSVSSTVTPENGTTNGYKSGFTQTDAANGNSSHGGKGSASSSTPAHTGNYSLSPRPSYASGDQATMFISGPPKKRHRGWYPGSPLPQPGLVVPVPTVRPLSRTEPLLSAPVPQTPLTGILQPRPIPAGETVIVPENLLSNSGVRPVILIGYGTLPYFYGNVGDIVVSPLLVNCYKIPQLENKDLEKLGLTGSQFLSVENMILLTIQYLVRLGPDQVPLREEFEQIMLKAMQEFTLRERALQIGAQCVPVSPGQLPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLDLDNETFHIYQPQLTVARKLLSQVCAIADSGSQSLDLGHFSKVDFIIIVPRSEVLVQQTLQRIRQSGVLVDLGLEENGTAHQRAEKYVVRLDNEIQTKFEVFMRRVKQNPYTLFVLVHDNSHVELTSVISGSLSHSEPSHGLADRVINCREVLEAFNLLVLQVSSFPYTLQTQQSRISSSNEVHWIQLDTGEDVGCEEKLYFGLSEYSKSLQWGITSPLLRCDETFEKMVNTLLERYPRLHSMVVRCYLLIQQYSEALMALTTMASLRDHSTPETLSIMDDLISSPGKNKSGRGHMLIIRVPSVQLAMLAKERLQEVRDKLGLQYRFEIILGNPATELSVATHFVARLKSWRGNEPEEWIPRTYQDLDGLPCIVILTGKDPLGETFPRSLKYCDLRLIDSSYLTRTALEQEVGLACCYVSKEVIRGPTVALDLSGKEQERAAVSENDSDELLIDLERPQSNSSAVTGTSGSIMENGVSSSSTADKSQKQSLTPSFQSPATSLGLDEGVSASSAGAGAGETLKQECDSLGPQMASSTTSKPSSSSSGPRTLPWPGQPIRGCRGPQAALPPVVILSKAAYSLLGSQKSGKLPSSSSLLPHADVAWVSSLRPLLNKDMSSEEQSLYYRQWTLARQHHADYSNQLDPASGTRNFHPRRLLLTGPPQVGKTGSYLQFLRILFRMLIRLLEVDVYDEEEINTDHNESSEVSQSEGEPWPDIESFSKMPFDVSVHDPKYSLMSLVYTEKLAGVKQEVIKESKVEEPRKRETVSIMLTKYAAYNTFHHCEQCRQYMDFTSASQMSDSTLHAFTFSSSMLGEEVQLYFIIPKSKESHFVFSKQGKHLESMRLPLVSDKNLNAVKSPIFTPSSGRHEHGLLNLFHAMEGISHLHLLVVKEYEMPLYRKYWPNHIMLVLPGMFNNAGVGAARFLIKELSYHNLELERNRLEELGIKRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMVSESLAPILPLQYICAPDSEHTLLAAPAQFLLEKFLQHASYKLFPKAIHNFRSPVLAIDCYLNIGPEVAICYISSRPHSSNVNCEGVFFSGLLLYLCDSFVGADLKKFKFLKGATLCVICQDRSSLRQTIVRLELEDEWQFRLRDEFQTANSSDDKPLYFLTGRHV

SEQ ID NO: 29293 - protein, 200 aa, Homo sapiens
  ENSP00000463926
  MOD_RES (1)..(1): Any amino acid
XKLTTQPKKQKHLKYYLVRSSQGVLSKGPLICWKECRSRQSSASCHSIKPSSSVSSTVTPENGTTNGYKSGFTQTDSPILSPANSAINLSGAQDLTRNNNVVKPLALSLQVVGKTFAADAANGNSSHGGKGSASSSTPAHTGNYSLSPRPSYASGDQATMFISGPPKKRHRGWYPGSPLPQPGLVVPVPTVRPLSRTEPL

SEQ ID NO: 29294 - protein, 175 aa, Homo sapiens
  ENSP00000463976
LPWLARLIASVSQDLVHVVVTQNSLAEGISETLRTLSEMRHYQRLPDYVVVICASKIRGNEFCVVVLGQHQSRALAESMLTTSEFLKEISYELITGKVSFLASHFKTTSLGDDLDKLLEKMQQRRGDSVVTPFDGDLNECVSPQEAAAMIPTQNLGNVISDQEEEVSPWDRHCKN

SEQ ID NO: 29295 - protein, 190 aa, Homo sapiens
  ENSP00000462152
  MOD_RES (1)..(1): Any amino acid
XRQCVWPFIVMMDDSCVLWNIHSVQEPSSQPMEVGVSSKNVSLKTVLQHIEATPKIVHYAILGIQKWSSKLTSQSLKAPFSRCHVHDFILLNTDLTQNVQYDFNRYFCEDADFNLRTNSSGLLICRFNNFSLMKKHVQVGGQRDFIIKPKIMPSITSGVLCWPLTATLTLDQRWPYAISAPDPTPAMSTV

SEQ ID NO: 29296 - protein, 1923 aa, Homo sapiens; identical to SEQ ID NO: 29292
  ENSP00000412060

SEQ ID NO: 29297 - protein, 93 aa, Homo sapiens
  ENSP00000387521
MTQEYDNKRPVLVLQNEALYPQRRSYTSEDEAWKSFLENPLTAATKAMMSINGDEDSAAALGLLYDYYKVPRERRSSTAKPEVEHPEPDHSKR

SEQ ID NO: 29298 - protein, 229 aa, Homo sapiens
  ENSP00000420654
MRKWTKKGNCKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEEQL

SEQ ID NO: 29299 - protein, 618 aa, Homo sapiens
  ENSP00000324693
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 29300 - protein, 511 aa, Homo sapiens
  ENSP00000418275
MTQEYDNKRPVLVLQNEALYPQRRSYTSEDEAWKSFLENPLTAATKAMMSINGDEDSAAALGLLYDYYKVPRERRSSTAKPEVEHPEPDHSKRNSIPIVTEQPLISAGENRVQVLKNVPFNIVLPHGNQLGIDKRGHLTAPDTTVTVSIATMPTHSIKTETQPHGFAVGIPPAVYHPEPTERVVVFDRNLNTDQFSSGAQAPNAQRRTPDSTFSETFKEGVQEVFFPSDLSLRMPGMNSEDYVFDSVSGNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKGKCPDPSSQFLMLKCHCFPLTSEWISQFSNPSLISILSLSSSFLTCTLPTCSGALMSFPLPLKNWRVKALS

SEQ ID NO: 29301 - protein, 72 aa, Homo sapiens
  ENSP00000419831
MLKTPSLKGLMEAISDKYDVPHDKIGKIFKKCKKGILVNMDDNIVKHYSNEDTFQLQIEEAGGSYKLTLTEI

SEQ ID NO: 29302 - protein, 429 aa, Homo sapiens
  ENSP00000384209
MASLWESPQQCIILSPLSGWWFSIGISILTSSALVLKPQMLKGELQTRPSQRPSRKAFRRNNFEYTLEASKSLRQKPGDSTMTYLNKGQFYPITLKEVSSSEGIHHPISKVRSVIMVVFAEDKSREDQLRHWKYWHSRQHTAKQRCIDIADYKESFNTISNIEEIAYNAISFTWDINDEAKVFISVNCLSTDFSSQKGVKGLPLNIQVDTYSYNNRSNKPVHRAYCQIKVFCDKGAERKIRDEERKQSKRKVSDVKVPLLPSHKRMDITVFKPFIDLDTQPVLFIPDVHFANLQRGTHVLPIASEELEGEGSVLKRGPYGTEDDFAVPPSTKLARIEEPKRVLLYVRKESEEVFDALMLKTPSLKGLMEAISDKYDVPHDKIGKIFKKCKKGILVNMDDNIVKHYSNEDTFQLQIEEAGGSYKLTLTEI

SEQ ID NO: 29303 - protein, 906 aa, Homo sapiens
  ENSP00000285900
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29304 - protein, 826 aa, Homo sapiens
  ENSP00000427920
MQHIFAFFCTGFLGAVVGANFPNNIQIGGLFPNQQSQEHAAFRFALSQLTEPPKLLPQIDIVNISDSFEMTYRCLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29305 - protein, 906 aa, Homo sapiens
  ENSP00000339343
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29306 - protein, 837 aa, Homo sapiens
  ENSP00000427864
MTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29307 - protein, 916 aa, Homo sapiens
  ENSP00000415569
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29308 - protein, 916 aa, Homo sapiens
  ENSP00000428994
MCCSTHLFQPLQLAGGLEWPWSNLLCFLTPVKLHPEVWGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 29309 - protein, 144 aa, Homo sapiens
  ENSP00000479607
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGARQNWAYCIWGVTGEL

SEQ ID NO: 29310 - protein, 144 aa, Homo sapiens; identical to SEQ ID NO: 29309
  ENSP00000478758

SEQ ID NO: 29311 - protein, 894 aa, Homo sapiens
  ENSP00000446440
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 29312 - protein, 894 aa, Homo sapiens
  ENSP00000478489
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 29313 - protein, 894 aa, Homo sapiens; identical to SEQ ID NO: 29311
  ENSP00000481554

SEQ ID NO: 29314 - protein, 824 aa, Homo sapiens
  ENSP00000481875
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKNACKPCSIETQ

SEQ ID NO: 29315 - protein, 1009 aa, Homo sapiens
  ENSP00000330148
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 29316 - protein, 755 aa, Homo sapiens
  ENSP00000433064
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKDPGAAGHRGPGCAEAEVVAAHGPL

SEQ ID NO: 29317 - protein, 1007 aa, Homo sapiens
  ENSP00000282020
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 29318 - protein, 912 aa, Homo sapiens
  ENSP00000421257
MEVFPFLLVLSVWWSRTWDSANADSIIHIGAIFDESAKKDDEVFRTAVGDLNQNEEILQTEKITFSVTFVDGNNPFQAVQEDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 29319 - protein, 163 aa, Homo sapiens
  ENSP00000422845
MNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEMSF

SEQ ID NO: 29320 - protein, 73 aa, Homo sapiens
  ENSP00000423331
MEISNLYIYDTVLLLANAFHKKLEDRKWHSMASLSCIRKNSKPWQGGRSMLETIKKGGVSGLTGELEFGENGG

SEQ ID NO: 29321 - protein, 62 aa, Homo sapiens
  ENSP00000425794
GGVSGLTGELEFGENGGNPNVHFEILGTNYGEELGRGVRKNERIRPQGSTGKIWPQVNFIFK

SEQ ID NO: 29322 - protein, 126 aa, Homo sapiens
  ENSP00000490775
  MOD_RES (1)..(1): Any amino acid
XGDMDILKHKWWPKNGQCDLYSSVDTKQKGGALDIKSFAGVFCILAAGIVLSCFIAMLETWWNKRKGSRVPSKEASSLQNETTISERRNAWPLRPCLKLGSNTWRSQASSHSLHQSSQMGGPLDDP

SEQ ID NO: 29323 - protein, 926 aa, Homo sapiens
  ENSP00000483084
ACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 29324 - protein, 1020 aa, Homo sapiens
  ENSP00000397887
MSCLGIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 29325 - protein, 1027 aa, Homo sapiens
  ENSP00000408364
MGKDQGFSRHFRIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 29326 - protein, 1211 aa, Homo sapiens
  ENSP00000397351
MATTATPATNQGWPEDFGFRLGGSGPCFVLEVAKGSSAHAGGLRPGDQILEVEGLAVGGLSRERLVRLARRCPRVPPSLGVLPAPDGGPGPGSGPAAPTTVLRAPRCGRGLALGRELLRLAGRKRPDAVHRERRRKAQEFSRKVDEILGDQPTAKEQVFAALKQFAAEQRVDDLVWTLTLALPREACGPLLDNLRIFIPKKHRARFDEVVSQGLLGKLCRARRAQGAQRLRRSRSEERPERLLVSTRASAPPRRPDEPPPRRASLLVGGLAGPGGARRTVRVYKGNKSFGFTLRGHGPVWIESVLPGSPADNAALKSGDRILFLNGLDMRNCSHDKVVSMLQGSGAMPTLVVEEGLVPFASDSDSLDSPNPSSALTSLQWVAEILPSSIRVQGRTFSQQLEHLLTPPERYGVCRALESFFQHRNIDTLIVDVYPVLDTPAKQVLWQFIYQLLTYEEQELCQEKIACFLGYTAMTAEPEPELDLESEPTPEPQPRSSLRASSMCRRSLRSQGLEAGLSCGPSECPEMPLPLIPGERQAGDGTSLPETPNPKMMSAVYAELESRLNSSFKGKMGTVSKSRASPPGPSPAVTTGPRTLSGVSWPSERLLPSPCYHPLCSGGLASPSSSESHPYASLDSSRAPSPQPGPGPICPDSPPSPDPTRPPSRRKLFTFSHPVRSRDTDRFLDVLSEQLGPRVTIVDDFLTPENDYEEMSFHDDQGSFVTNERSSASDCISSSEEGSSLTYSSISDHIPPPPLSPPPPPPLPFHDAKPSSRSSDGSRGPAQALAKPLTQLSHPVPPPPPPPLPPPVPCAPPMLSRGLGHRRSETSHMSVKRLRWEQVENSEGTIWGQLGEDSDYDKLSDMVKYLDLELHFGTQKPAKPVPGPEPFRKKEVVEILSHKKAYNTSILLAHLKLSPAELRQVLMSMEPRRLEPAHLAQLLLFAPDADEEQRYQAFREAPGRLSEPDQFVLQMLSVPEYKTRLRSLHFQATLQEKTEEIRGSLECLRQASLELKNSRKLAKILEFVLAMGNYLNDGQPKTNKTTGFKINFLTELNSTKTVDGKSTFLHILAKSLSQHFPELLGFAQDLPTVPLAAKVNQRALTSDLADLHGTISEIQDACQSISPSSEDKFAMVMSSFLETAQPALRALDGLQREAMEELGKALAFFGEDSKATTSEAFFGIFAEFMSKFERALSDLQAGEGLRSSGMVSPLAW

SEQ ID NO: 29327 - protein, 949 aa, Homo sapiens
  ENSP00000327687
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 29328 - protein, 905 aa, Homo sapiens
  ENSP00000373777
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 29329 - protein, 920 aa, Homo sapiens
  ENSP00000382797
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 29330 - protein, 934 aa, Homo sapiens
  ENSP00000382798
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQKGKSSRIRFYFRNKVRFHGRKKQSLGVEKCLSFNAIMEELGISLKNQKKIKKKSRTKGKSSFTSILTCHQRRTQRKETVA

SEQ ID NO: 29331 - protein, 871 aa, Homo sapiens
  ENSP00000373776
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQHY

SEQ ID NO: 29332 - protein, 918 aa, Homo sapiens
  ENSP00000382791
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 29333 - protein, 903 aa, Homo sapiens
  ENSP00000382793
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 29334 - protein, 908 aa, Homo sapiens
  ENSP00000397026
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 29335 - protein, 869 aa, Homo sapiens
  ENSP00000405596
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 29336 - protein, 892 aa, Homo sapiens
  ENSP00000358134
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 29337 - protein, 353 aa, Homo sapiens
  ENSP00000351128
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTMEFHSCCPGWSAMARSQLTATSASWVQAILLPQPPE

SEQ ID NO: 29338 - protein, 180 aa, Homo sapiens
  ENSP00000391988
CSHEMAAGILKQALAMGMMTEYYHYIFTTLTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLL

SEQ ID NO: 29339 - protein, 182 aa, Homo sapiens
  ENSP00000407140
IGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIAR

SEQ ID NO: 29340 - protein, 870 aa, Homo sapiens
  ENSP00000358130
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 29341 - protein, 854 aa, Homo sapiens
  ENSP00000313276
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 29342 - protein, 831 aa, Homo sapiens
  ENSP00000358133
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 29343 - protein, 919 aa, Homo sapiens [sequence omitted]

SEQ ID NO: 29344 - protein, 872 aa, Homo sapiens
  ENSP00000362185
MTAPWRRLRSLVWEYWAGLLVCAFWIPDSRGMPHVIRIGGIFEYADGPNAQVMNAEEHAFRFSANIINRNRTLLPNTTLTYDIQRIHFHDSFEATKKACDQLALGVVAIFGPSQGSCTNAVQSICNALEVPHIQLRWKHHPLDNKDTFYVNLYPDYASLSHAILDLVQYLKWRSATVVYDDSTGLIRLQELIMAPSRYNIRLKIRQLPIDSDDSRPLLKEMKRGREFRIIFDCSHTMAAQILKQAMAMGMMTEYYHFIFTTLDLYALDLEPYRYSGVNLTGFRILNVDNPHVSAIVEKWSMERLQAAPRSESGLLDGVMMTDAALLYDAVHIVSVCYQRAPQMTVNSLQCHRHKAWRFGGRFMNFIKEAQWEGLTGRIVFNKTSGLRTDFDLDIISLKEDGLEKVGVWSPADGLNITEVAKGRGPNVTDSLTNRSLIVTTVLEEPFVMFRKSDRTLYGNDRFEGYCIDLLKELAHILGFSYEIRLVEDGKYGAQDDKGQWNGMVKELIDHKADLAVAPLTITHVREKAIDFSKPFMTLGVSILYRKPNGTNPSVFSFLNPLSPDIWMYVLLAYLGVSCVLFVIARFSPYEWYDAHPCNPGSEVVENNFTLLNSFWFGMGSLMQQGSELMPKALSTRIIGGIWWFFTLIIISSYTANLAAFLTVERMESPIDSADDLAKQTKIEYGAVKDGATMTFFKKSKISTFEKMWAFMSSKPSALVKNNEEGIQRALTADYALLMESTTIEYVTQRNCNLTQIGGLIDSKGYGIGTPMGSPYRDKITIAILQLQEEDKLHIMKEKWWRGSGCPEEENKEASALGIQKIGGIFIVLAAGLVLSVLVAVGEFVYKLRKTAEREQVSLRAWSLHRMGNGDSR

SEQ ID NO: 29345 - protein, 1464 aa, Homo sapiens [sequence omitted]

SEQ ID NO: 29346 - protein, 1281 aa, Homo sapiens
  ENSP00000454998
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQMLDFISSHTFVPILGIHGGASMIMADKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 29347 - protein, 1464 aa, Homo sapiens [sequence omitted]

SEQ ID NO: 29348 - protein, 200 aa, Homo sapiens
  ENSP00000490232
DKDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHP

SEQ ID NO: 29349 - protein, 19 aa, Homo sapiens
  ENSP00000490676
MGRVGYWTLLVLPALLVWR

SEQ ID NO: 29350 - protein, 10 aa, Homo sapiens
  ENSP00000489946
MGRVGYWTLL

SEQ ID NO: 29351 - protein, 1144 aa, Homo sapiens
  ENSP00000441572
QDPTSTFFQFGASIQQQATVMLKIMQDYDWHVFSLVTTIFPGYREFISFVKTTVDNSFVGWDMQNVITLDTSFEDAKTQVQLKKIHSSVILLYCSKDEAVLILSEARSLGLTGYDFFWIVPSLVSGNTELIPKEFPSGLISVSYDDWDYSLEARVRDGIGILTTAASSMLEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSIVTLEEAPFVIVEDIDPLTETCVRNTVPCRKFVKINNSTNEGMNVKKCCKGFCIDILKKLSRTVKFTYDLYLVTNGKHGKKVNNVWNGMIGEVVYQRAVMAVGSLTINEERSEVVDFSVPFVETGISVMVSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGMTNAWLLGDAPRTLTNTRCHPRR

SEQ ID NO: 29352 - protein, 46 aa, Homo sapiens
  ENSP00000489997
ANLAAFMIQEEYVDQVSGLSDKKMRTLRLRRSIFPKVTKLVTEPGF

SEQ ID NO: 29353 - protein, 1484 aa, Homo sapiens [sequence omitted]

SEQ ID NO: 29354 - protein, 35 aa, Homo sapiens
  ENSP00000486677
MKPRAECCSPKFWLVLAVLAVSGSRARSQKSPPSI

SEQ ID NO: 29355 - protein, 35 aa, Homo sapiens; identical to SEQ ID NO: 29354
  ENSP00000486411

SEQ ID NO: 29356 - protein, 1233 aa, Homo sapiens
  ENSP00000293190
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 29357 - protein, 873 aa, Homo sapiens
  ENSP00000338645
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRVGAHPSPHRPKF

SEQ ID NO: 29358 - protein, 1336 aa, Homo sapiens
  ENSP00000263269
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 29359 - protein, 1076 aa, Homo sapiens
  ENSP00000381098
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 29360 - protein, 928 aa, Homo sapiens
  ENSP00000439053
  MOD_RES (1)..(1): Any amino acid
XPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 29361 - protein, 121 aa, Homo sapiens
  ENSP00000443006
LEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMGESCPNQRL

SEQ ID NO: 29362 - protein, 1056 aa, Homo sapiens
  ENSP00000446047
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETRE

SEQ ID NO: 29363 - protein, 876 aa, Homo sapiens
  ENSP00000446024
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHAALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTL

SEQ ID NO: 29364 - protein, 787 aa, Homo sapiens
  ENSP00000446011
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEATIMSGSTMSLNHEAPTPRSQLGRQASFQERSSSRP

SEQ ID NO: 29365 - protein, 283 aa, Homo sapiens
  ENSP00000443860
  MOD_RES (1)..(1): Any amino acid
XVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERC

SEQ ID NO: 29366 - protein, 77 aa, Homo sapiens
  ENSP00000440918
  MOD_RES (1)..(1): Any amino acid
XSVATASGPLLVEVAKTPGASLGVALTTSMCCNKQVIVIDKIKSASIADSENSEERQATYLGFLGQQPQQPSHQPSL

SEQ ID NO: 29367 - protein, 210 aa, Homo sapiens
  ENSP00000439124
MIAVSFKCRCQILRRLTKEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYD

SEQ ID NO: 29368 - protein, 149 aa, Homo sapiens
  ENSP00000438500
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLS

SEQ ID NO: 29369 - protein, 120 aa, Homo sapiens
  ENSP00000443392
MKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNK

SEQ ID NO: 29370 - protein, 188 aa, Homo sapiens
  ENSP00000438921
MDRFLGFVKAIRRSRRRKGKKYRPEEDYHEGYEDVYYYASEHFRNESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTF

SEQ ID NO: 29371 - protein, 15 aa, Homo sapiens
  ENSP00000446067
MKKEGTTLGLTVSGG

SEQ ID NO: 29372 - protein, 1128 aa, Homo sapiens
  ENSP00000352780
MIAVSFKCRCQILRRLTKDESPYTKSASQTKPPDGALAVRRQSIPEEFKGSTVVELMKKEGTTLGLTVSGGIDKDGKPRVSNLRQGGIAARSDQLDVGDYIKAVNGINLAKFRHDEIISLLKNVGERVVLEVEYELPPVSVQGSSVIFRTVEVTLHKEGNTFGFVIRGGAHDDRNKSRPVVITCVRPGGPADREGTIKPGDRLLSVDGIRLLGTTHAEAMSILKQCGQEAALLIEYDVSVMDSVATASGPLLVEVAKTPGASLGVALTTSMCCNKQVIVIDKIKSASIADRCGALHVGDHILSIDGTSMEYCTLAEATQFLANTTDQVKLEILPHHQTRLALKGPDHVKIQRSDRQLTWDSWASNHSSLHTNHHYNTYHPDHCRVPALTFPKAPPPNSPPALVSSSFSPTSMSAYSLSSLNMGTLPRSLYSTSPRGTMMRRRLKKKDFKSSLSLASSTVGLAGQVVHTETTEVVLTADPVTGFGIQLQGSVFATETLSSPPLISYIEADSPAERCGVLQIGDRVMAINGIPTEDSTFEEASQLLRDSSITSKVTLEIEFDVAESVIPSSGTFHVKLPKKHNVELGITISSPSSRKPGDPLVISDIKKGSVAHRTGTLELGDKLLAIDNIRLDNCSMEDAVQILQQCEDLVKLKIRKDEDNSDEQESSGAIIYTVELKRYGGPLGITISGTEEPFDPIIISSLTKGGLAERTGAIHIGDRILAINSSSLKGKPLSEAIHLLQMAGETVTLKIKKQTDAQSASSPKKFPISSHLSDLGDVEEDSSPAQKPGKLSDMYPSTVPSVDSAVDSWDGSAIDTSYGTQGTSFQASGYNFNTYDWRSPKQRGSLSPVTKPRSQTYPDVGLSYEDWDRSTASGFAGAADSAETEQEENFWSQALEDLETCGQSGILRELEEKADRRVSLRNMTLLATIMSGSTMSLNHEAPTPRSQLGRQASFQERSSSRPHYSQTTRSNTLPSDVGRKSVTLRKMKQEIKEIMSPTPVELHKVTLYKDSDMEDFGFSVADGLLEKGVYVKNIRPAGPGDLGGLKPYDRLLQVNHVRTRDFDCCLVVPLIAESGNKLDLVISRNPLASQKSIDQQSLPGDWSEQNSAFFQQPSHGGNLETREPTNTL

SEQ ID NO: 29373 - protein, 688 aa, Homo sapiens
  ENSP00000317578
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRGHSPFRQHKTKDKHEIDRMTLTVNVELPDTFSPELKSLLEGLLQRDVSKRLGCHGGGSQEVKEHSFFKGVDWQHVYLQKYPPPLIPPRGEVNAADAFDIGSFDEEDTKGIKLLDCDQELYKNFPLVISERWQQEVTETVYEAVNADTDKIEARKRAKNKQLGHEEDYALGKDCIMHGYMLKLGNPFLTQWQRRYFYLFPNRLEWRGEGESRQNLLTMEQILSVEETQIKDKKCILFRIKGGKQFVLQCESDPEFVQWKKELNETFKEAQRLLRRAPKFLNKPRSGTVELPKPSLCHRNSNGL

SEQ ID NO: 29374 - protein, 45 aa, Homo sapiens
  ENSP00000393688
TPAARASKRIVLPEPSIRSVMQKYLAERNEITFDKIFNQKIDKGI

SEQ ID NO: 29375 - protein, 387 aa, Homo sapiens
  ENSP00000478925
MADLEAVLADVSYLMAMEKSKATPAARASKRIVLPEPSIRSVMQKYLAERNEITFDKIFNQKIGFLLFKDFCLNEINEAVPQVKFYEEIKEYEKLDNEEDRLCRSRQIYDAYIMKELLSCSHPFSKQAVEHVQSHLSKKQVTSTLFQPYIEEICESLRGDIFQKFMESDKFTRFCQWKNVELNIHLTMNEFSVHRIIGRGGFGEVYGCRKADTGKMYAMKCLDKKRIKMKQGETLALNERIMLSLVSTGDCPFIVCMTYAFHTPDKLCFILDLMNGGDLHYHLSQHGVFSEKEMRFYATEIILGLEHMHNRFVVYRDLKPANILLDEHGHARISDLGLACDFSKKKPHASVGTHGYMAPEVLQKGTAYDSSADWFSLGCMLFKLLRG

SEQ ID NO: 29376 - protein, 500 aa, Homo sapiens
  ENSP00000381128
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 29377 - protein, 84 aa, Homo sapiens
  ENSP00000421650
MELENIVANSLLLKARQVLCIPPQKHQLVQPFSGRPPQSSVQSSVSDLMSPLPASQESWRQSLGPQVPVLATVVLHTPSLLRNC

SEQ ID NO: 29378 - protein, 578 aa, Homo sapiens [sequence omitted]

SEQ ID NO: 29379 - protein, 546 aa, Homo sapiens
  ENSP00000264764
MELENIVANSLLLKARQEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEMIESGCFKDINKSESEEALPLDLDKNIHTPVSRPNRGFFYRLFRRGGCLTMVPSEKEVEPKQC

SEQ ID NO: 29380 - protein, 532 aa, Homo sapiens
  ENSP00000427445
MELENIVANSLLLKARQGGYGKKSGRSKKWKEILTLPPVSQCSELRHSIEKDYSSLCDKQPIGRRLFRQFCDTKPTLKRHIEFLDAVAEYEVADDEDRSDCGLSILDRFFNDKLAAPLPEIPPDVVTECRLGLKEENPSKKAFEECTRVAHNYLRGEPFEEYQESSYFSQFLQWKWLERQPVTKNTFRHYRVLGKGGFGEVCACQVRATGKMYACKKLQKKRIKKRKGEAMALNEKRILEKVQSRFVVSLAYAYETKDALCLVLTIMNGGDLKFHIYNLGNPGFDEQRAVFYAAELCCGLEDLQRERIVYRDLKPENILLDDRGHIRISDLGLATEIPEGQRVRGRVGTVGYMAPEVVNNEKYTFSPDWWGLGCLIYEMIQGHSPFKKYKEKVKWEEVDQRIKNDTEEYSEKFSEDAKSICRMLLTKNPSKRLGCRGEGAAGVKQHPVFKDINFRRLEANMLEPPFCPDPHAVYCKDVLDIEQFSVVKGIYLDTADEDFYARFATGCVSIPWQNEGCLTMVPSEKEVEPKQC

SEQ ID NO: 29381 - protein, 590 aa, Homo sapiens
  ENSP00000376609
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRDLKPENILLDDYGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 29382 - protein, 906 aa, Homo sapiens
  ENSP00000424095
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKKRQPEFSPTSQCPSAHVQL

SEQ ID NO: 29383 - protein, 908 aa, Homo sapiens
  ENSP00000347437
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNAKWRTGAQGTAYVAPPLCAREDQ

SEQ ID NO: 29384 - protein, 1194 aa, Homo sapiens
  ENSP00000282753
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 29385 - protein, 906 aa, Homo sapiens; identical to SEQ ID NO: 29382
  ENSP00000425599

SEQ ID NO: 29386 - protein, 1194 aa, Homo sapiens; identical to SEQ ID NO: 29384
  ENSP00000354896

SEQ ID NO: 29387 - protein, 912 aa, Homo sapiens
  ENSP00000440556
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29388 - protein, 796 aa, Homo sapiens
  ENSP00000363292
MPAWEPGVAASCGWRAPPCSPLRLCIAPHPCTPPSSHQGNLTCRLPPRSFGFCRCVWVRTRGPSLPGEQVSLAAHESEGAAAQLGSSPEIDPRRPRCLLPESAQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29389 - protein, 779 aa, Homo sapiens
  ENSP00000477466
MAVPLGAPCWASALPAWAPPGLPHRSLLTRLLSQHVKPAKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29390 - protein, 743 aa, Homo sapiens
  ENSP00000437730
MSCKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29391 - protein, 772 aa, Homo sapiens
  ENSP00000398456
MVQTLPKLFPHDGAKRKKRTLRTSGPCFGGGGQIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29392 - protein, 181 aa, Homo sapiens
  ENSP00000477016
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKGACASPSR

SEQ ID NO: 29393 - protein, 96 aa, Homo sapiens
  ENSP00000476561
MGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEG

SEQ ID NO: 29394 - protein, 779 aa, Homo sapiens; identical to SEQ ID NO: 29389
  ENSP00000437925

SEQ ID NO: 29395 - protein, 865 aa, Homo sapiens
  ENSP00000363296
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRDRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 29396 - protein, 1180 aa, Homo sapiens
  ENSP00000305905
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 29397 - protein, 1212 aa, Homo sapiens
  ENSP00000306138
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 29398 - protein, 87 aa, Homo sapiens
  ENSP00000403724
  MOD_RES (1)..(1): Any amino acid
XQIAYSATSMDLSDKTLFKYFMRVVPSDAQQARAMVDIVKRYNWTYVSAVHTEGRGTKKEEMRKRDQTLMLSFMRFKLFSCLSLQRS

SEQ ID NO: 29399 - protein, 298 aa, Homo sapiens
  ENSP00000376972
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGRGTKKEEMRKRDQTLMLSFMRCVFLRFEEIRWNDSLVYDALENENIQVLSLCFPSSAVIQINTFLSPIALINRLNVT

SEQ ID NO: 29400 - protein, 1180 aa, Homo sapiens; identical to SEQ ID NO: 29396
  ENSP00000405690

SEQ ID NO: 29401 - protein, 68 aa, Homo sapiens
  ENSP00000404161
MNPVPQMEMQKSPVFGHLGSSPEVLWNTRYYTEAAIWKDHLERFFIKTEPQSIRKHPCLISMKVMRRT

SEQ ID NO: 29402 - protein, 122 aa, Homo sapiens
  ENSP00000393799
MVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIA

SEQ ID NO: 29403 - protein, 922 aa, Homo sapiens
  ENSP00000419835
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 29404 - protein, 915 aa, Homo sapiens
  ENSP00000350348
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 29405 - protein, 922 aa, Homo sapiens; identical to SEQ ID NO: 29403
  ENSP00000417536

SEQ ID NO: 29406 - protein, 913 aa, Homo sapiens
  ENSP00000412329
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNFFFWLYSGTWITL

SEQ ID NO: 29407 - protein, 906 aa, Homo sapiens
  ENSP00000373987
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSEKCNCY

SEQ ID NO: 29408 - protein, 911 aa, Homo sapiens
  ENSP00000373986
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNITSEDLSLHKED

SEQ ID NO: 29409 - protein, 37 aa, Homo sapiens
  ENSP00000405194
MAPELHWGDALLSCLSFPILNVLQKSPRLVMHQRHPS

SEQ ID NO: 29410 - protein, 185 aa, Homo sapiens
  ENSP00000395035
MGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCK

SEQ ID NO: 29411 - protein, 677 aa, Homo sapiens
  ENSP00000384585
GGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 29412 - protein, 908 aa, Homo sapiens
  ENSP00000344173
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 29413 - protein, 908 aa, Homo sapiens
  ENSP00000351142
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNSKSSVEFPMVKSGSTS

SEQ ID NO: 29414 - protein, 501 aa, Homo sapiens
  ENSP00000345747
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGCRRGIQMSLPWPTLFTPSFSSSWAVLALLSLLMKTEMLLDVMISSSIK

SEQ ID NO: 29415 - protein, 908 aa, Homo sapiens; identical to SEQ ID NO: 29413
  ENSP00000419832

SEQ ID NO: 29416 - protein, 293 aa, Homo sapiens
  ENSP00000415522
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEA

SEQ ID NO: 29417 - protein, 91 aa, Homo sapiens
  ENSP00000418255
FFSRVVPPDSYQAQAMVDIVTALGWNYVSTLASEGNYGESGVEAFTQISREIGYPSLFGIQGCLHECFAILCQVVYQFLLLMQLSDAQTVY

SEQ ID NO: 29418 - protein, 20 aa, Homo sapiens
  ENSP00000398012
MVCEGKRSASCPCFFLLTAK

SEQ ID NO: 29419 - protein, 416 aa, Homo sapiens
  ENSP00000409790
NFLYPQVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 29420 - protein, 854 aa, Homo sapiens
  ENSP00000257626
MALRLVADFDLGKDVLPWLRAQRAVSEASGAGSGGADVLENDYESLHVLNVERNGNIIYTYKDDKGNVVFGLYDCQTRQNELLYTFEKDLQVFSCSVNSERTLLAASLVQSTKEGKRNELQPGSKCLTLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQIIQWISENVSACHSFDLIQEFIIASSYWSVYSETSNMDKLLPHSSVLTWNTEIPGITLVTEDIALPLMKVLSFKGYWEKLNSNLEYVKYAKPHFHYNNSVVRREWHNLISEEKTGKRRSAAYVRNILDNAVKVISNLEARNLGPRLTPLLQEEDSHQRLLMGLMVSELKDHFLRHLQGVEKKKIEQMVLDYISKLLDLICHIVETNWRKHNLHSWVLHFNSRGSAAEFAVFHIMTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 29421 - protein, 188 aa, Homo sapiens
  ENSP00000396230
VLSFKGYWEKLNSNLEYVKYAKPHFHYNNSVVRREWHNLISEEKTGKRRSAAYVRNILDNAVKVISNLEARNLGPRLTPLLQEEDSHQRLLMGLLDLICHIVETNWRKHNLHSWVLHFNSRGSAAEFAVFHIMTRILEATNSLFLPLPPGFHTLHTILGVQCLPLHNLLHCIDSGVLLLTETAVIRLM

SEQ ID NO: 29422 - protein, 58 aa, Homo sapiens
  ENSP00000402748
MLKEMEILFIPIRMIREMSSLDYMIVKPDKMSFYIPLRKTCKFSVALSTVKGLCLLQV

SEQ ID NO: 29423 - protein, 175 aa, Homo sapiens
  ENSP00000415402
MTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 29424 - protein, 731 aa, Homo sapiens
  ENSP00000362929
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29425 - protein, 260 aa, Homo sapiens
  ENSP00000404226
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMS

SEQ ID NO: 29426 - protein, 742 aa, Homo sapiens
  ENSP00000362914
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29427 - protein, 767 aa, Homo sapiens
  ENSP00000409358
MNTGLTRLLWPSWLPDGDMSHPQPELFLFPKAQPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29428 - protein, 232 aa, Homo sapiens
  ENSP00000489067
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQ

SEQ ID NO: 29429 - protein, 748 aa, Homo sapiens
  ENSP00000377882
MAEEEALRGNSDPWPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29430 - protein, 739 aa, Homo sapiens
  ENSP00000445823
MPLCTPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29431 - protein, 782 aa, Homo sapiens
  ENSP00000362924
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 29432 - protein, 67 aa, Homo sapiens
  ENSP00000362912
  MOD_RES (1)..(1): Any amino acid
XKGGTSREGGQTAPASTRLFQVRANSAGATRAVEVISRSWNTEGIGLPETSQLNDQISRHRNGGRGW

SEQ ID NO: 29433 - protein, 218 aa, Homo sapiens
  ENSP00000311469
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 29434 - protein, 237 aa, Homo sapiens
  ENSP00000358838
MPMILGYWDIRGLAHAIRLLLEYTDSSYEEKKYTMGDAPDYDRSQWLNEKFKLGLDFPNGMLGSLVAQLSFAGFPSIQLPYLIDGAHKITQSNAILCYIARKHNLCGETEEEKIRVDILENQTMDNHMQLGMICYNPEFEKLKPKYLEELPEKLKLYSEFLGKRPWFAGNKITFVDFLVYDVLDLHRIFEPKCLDAFPNLKDFISRFEGLEKISAYMKSSRFLPRPVFSKMAVWGNK

SEQ ID NO: 29435 - protein, 181 aa, Homo sapiens
  ENSP00000234981
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLKLYSEFLGKRPWFAGNKGLEKISAYMKSSRFLPRPVFSKMAVWGNK

SEQ ID NO: 29436 - protein, 102 aa, Homo sapiens
  ENSP00000456315
MGDAPDYDRSQWLNEKFKLGLDFPNLPYLIDGAHKITQSNAILCYIARKHNLCGETEEEKIRVDILENQTMDNHMQLGMICYNPEFEKLKPKYLEELPEKLK

SEQ ID NO: 29437 - protein, 85 aa, Homo sapiens
  ENSP00000455929
MPMILGYWDIRGLAHAIRLLLEYTDSSYEEKKYTMGDAPDYDRSQWLNEKFKLGLDFPNVGRQKRRRFVWTFWRTRPWTTICSWA

SEQ ID NO: 29438 - protein, 149 aa, Homo sapiens
  ENSP00000358834
MPMILGYWDIRGLAHAIRLLLEYTDSSYEEKKYTMGDAPDYDRSQWLNEKFKLGLDFPNLPYLIDGAHKITQSNAILCYIARKHNLCGETEEEKIRVDILENQTMDNHMQLGMICYNPEFGLEKISAYMKSSRFLPRPVFSKMAVWGNK

SEQ ID NO: 29439 - protein, 243 aa, Homo sapiens
  ENSP00000345023
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 29440 - protein, 215 aa, Homo sapiens
  ENSP00000358721
MRFCPYSHRTRLVLKAKDIRHEVVNINLRNKPEWYYTKHPFGHIPVLETSQCQLIYESVIACEYLDDAYPGRKLFPYDPYERARQKMLLELFCKVPHLTKECLVALRCGRECTNLKAALRQEFSNLEEILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 29441 - protein, 209 aa, Homo sapiens
  ENSP00000390986
MSGDATRTLGKGSQPPGPVPEGLIRIYSMRFCPYSHRTRLVLKAKDIRHEVVNINLRNKPEWYYTKHPFGHIPVLETSQCQLIYESVIACEYLDDAYPGRKLFPYDPYERARQKMLLELFCKILEYQNTTFFGGTCISMIDYLLWPWFERLDVYGILDCVSHTPALRLWISAMKWDPTVCALLMDKSIFQGFLNLYFQNNPNAFDFGLC

SEQ ID NO: 29442 - protein, 264 aa, Homo sapiens
  ENSP00000304331
MPRSFLVDSLVLREAGEKKAPEGSPPPLFPYAVPPPHALHGLSPGACHARKAGLLCVCPLCVTASQLHGPPGPPALPLLKASFPPFGSQYCHAPLGRQHSAVSPGVAHGPAAAAAAAALYQTSYPLPDPRQFHCISVDSSSNQLPSSKRMRTAFTSTQLLELEREFASNMYLSRLRRIEIATYLNLSEKQVKIWFQNRRVKHKKEGKGSNHRGGGGGGAGGGGSAPQGCKCASLSSAKCSEDDDELPMSPSSSGKDDRDLTVTP

SEQ ID NO: 29443 - protein, 164 aa, Homo sapiens
  ENSP00000412645
MACLNPVLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPA

SEQ ID NO: 29444 - protein, 335 aa, Homo sapiens
  ENSP00000396702
MACLNPVPKLYRSVIEDVIEGVRNLFAEEGIEEQVLKDLKQLWETKVLQSKATEDFFRNSIQSPLFTLQLPHSLHQTLQSSTGWIPLVNEYSSLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEK

SEQ ID NO: 29445 - protein, 478 aa, Homo sapiens
  ENSP00000384597
MACLNPVPKLYRSVIEDVIEGVRNLFAEEGIEEQVLKDLKQLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 29446 - protein, 55 aa, Homo sapiens
  ENSP00000394793
MACLNPVLWETKVLQSKATEDFFRNSIQSPLFTLQLPHSLHQTLQSSTGWIPLHH

SEQ ID NO: 29447 - protein, 102 aa, Homo sapiens
  ENSP00000421474
SGDTSSNEEIGSTRDADENEFLGNIDGGDLKVPEEEADSISNEDSATNSSDNEDPQVNIVEEDPLNSGDDVSEQDVPDLFDTDNVIVCQYDKAFPRRTSFNT

SEQ ID NO: 29448 - protein, 444 aa, Homo sapiens
  ENSP00000387896
MACLNPVLWETKVLQSKATEDFFRNSIQSPLFTLQLPHSLHQTLQSSTASLVIPAGRTLPSFTTAELGTSNSSANFTFPGYPIHVPAGVTLQTVSGHLYKVNVPIMVTETSGRAGILQHPIQQVFQQLGQPSVIQTSVPQLNPWSLQATTEKSQRIETVLQQPAILPSGPVDRKHLENATSDILVSPGNEHKIVPEALLCHQESSHYISLPGVVFSPQVSQTNSNVESVLSGSASMAQNLHDESLSTSPHGALHQHVTDIQLHILKNRMYGCDSVKQPRNIEEPSNIPVSEKDSNSQVDLSIRVTDDDIGEIIQVDGSGDTSSNEEIGSTRDADENEFLGNIDGGDLKVPEEEADSISNEDSATNSSDNEDPQVNIVEEDPLNSGDDVSEQDVPDLFDTDNVIVCQYDKIHRSKNKWKFYLKDGVMCFGGRDYVFAKAIGDAEW

SEQ ID NO: 29449 - protein, 316 aa, Homo sapiens
  ENSP00000359531
MASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIARKAVELDLVPGRSPISVAAAAIYMASQASAEKRTQKEIGDIAGVADVTIRQSYRLIYPRAPDLFPTDFKFDTPVDKLPQL

SEQ ID NO: 29450 - protein, 224 aa, Homo sapiens
  ENSP00000415741
ASTSRLDALPRVTCPNHPDAILVEDYRAGDMICPECGLVVGDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRNWRYCWCC

SEQ ID NO: 29451 - protein, 231 aa, Homo sapiens
  ENSP00000402345
MASTSRLDALPRVTCPNHPDAILVEDYRAGDMICPECDRVIDVGSEWRTFSNDKATKDPSRVGDSQNPLLSDGDLSTMIGKGTGAASFDEFGNSKYQNRRTMSSSDRAMMNAFKEITTMADRINLPRNIVDRTNNLFKQVYEQKSLKGRANDAIASACLYIACRQEGVPRTFKEICAVSRISKKEIGRCFKLILKALETSVDLITTGDFMSRFCSNLCLPKQVQMAATHIA

SEQ ID NO: 29452 - protein, 105 aa, Homo sapiens
  ENSP00000436973
GMVMVSPEMNPTICSVFEAEIVLLFHATTFRRGFQVTVHVGNVRQTAVVEKIHAKDKLRTGEKAVVRFRFLKHPEYLKVQSSSIVTKYCGLFSVVQVSRILRPFT

SEQ ID NO: 29453 - protein, 153 aa, Homo sapiens
  ENSP00000392944
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVARERGVLSATCSLPTFWRGAKLGVARKGQS

SEQ ID NO: 29454 - protein, 154 aa, Homo sapiens
  ENSP00000398905
  MOD_RES (1)..(1): Any amino acid
XGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKVRGTWPSISPEVRKEGGLPQTGRELLDPTMGIKPHLGWVAA

SEQ ID NO: 29455 - protein, 602 aa, Homo sapiens
  ENSP00000303997
MDSRVSELFGGCCRPGGGPAVGGTLKARGAGSSSGCGGPKGKKKNGRNRGGKANNPPYLPPEAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 29456 - protein, 315 aa, Homo sapiens
  ENSP00000411358
  MOD_RES (1)..(1): Any amino acid
XQGGGAREENTSFRSRDPREEGQRLDSQAEDGNIEYKLKLVNPSQYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLV

SEQ ID NO: 29457 - protein, 227 aa, Homo sapiens
  ENSP00000410676
MDSRVSELFGGCCRPGGGPAVGGTLKARGAGSSSGCGGPKGKKKNGRNRGGKANNPPYLPPEAEDGNIEYKYRFEHLVTQMKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGE

SEQ ID NO: 29458 - protein, 514 aa, Homo sapiens
  ENSP00000304893
MKWRLQEGRGEAVYQIGVEDNGLLVGLAEEEMRASLKTLHRMAEKVGADITVLREREVDYDSDMPRKITEVLVRKVPDNQQFLDLRVAVLGNVDSGKSTLLGVLTQGELDNGRGRARLNLFRHLHEIQSGRTSSISFEILGFNSKGEVVNYSDSRTAEEICESSSKMITFIDLAGHHKYLHTTIFGLTSYCPDCALLLVSANTGIAGTTREHLGLALALKVPFFIVVSKIDLCAKTTVERTVRQLERVLKQPGCHKVPMLVTSEDDAVTAAQQFAQSPNVTPIFTLSSVSGESLDLLKVFLNILPPLTNSKEQEELMQQLTEFQVDEIYTVPEVGTVVGGTLSSGICREGDQLVVGPTDDGCFLELRVCSIQRNRSACRVLRAGQAATLALGDFDRALLRKGMVMVSPEMNPTICSVFEAEIVLLFHATTFRRGFQVTVHVGNVRQTAVVEKIHAKDKLRTGEKAVVRFRFLKHPEYLKVGAKLLFREGVTKGIGHVTDVQAITAGEAQANMGF

SEQ ID NO: 29459 - protein, 690 aa, Homo sapiens
  ENSP00000424361
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 29460 - protein, 690 aa, Homo sapiens; identical to SEQ ID NO: 29459
  ENSP00000421493

SEQ ID NO: 29461 - protein, 624 aa, Homo sapiens
  ENSP00000426968
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYR

SEQ ID NO: 29462 - protein, 690 aa, Homo sapiens; identical to SEQ ID NO: 29459
  ENSP00000412201

SEQ ID NO: 29463 - protein, 82 aa, Homo sapiens
  ENSP00000424863
MFCTKLKDLKITGECPFSLLAPGQVPNESSEEAAGSSESCKATVPICQDIPEKNIQESLPQRKTSGDHWRCLLCSWGITQRE

SEQ ID NO: 29464 - protein, 138 aa, Homo sapiens
  ENSP00000409903
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAEQPLPRSRKKGQA

SEQ ID NO: 29465 - protein, 432 aa, Homo sapiens
  ENSP00000377418
MKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 29466 - protein, 690 aa, Homo sapiens; identical to SEQ ID NO: 29459
  ENSP00000296518

SEQ ID NO: 29467 - protein, 143 aa, Homo sapiens
  ENSP00000422141
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGGDHWRCLLCSWGITQRE

SEQ ID NO: 29468 - protein, 690 aa, Homo sapiens; identical to SEQ ID NO: 29459
  ENSP00000426040

SEQ ID NO: 29469 - protein, 143 aa, Homo sapiens; identical to SEQ ID NO: 29467
  ENSP00000479710

SEQ ID NO: 29470 - protein, 470 aa, Homo sapiens
  ENSP00000381786
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 29471 - protein, 501 aa, Homo sapiens
  ENSP00000370555
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILQPANKVESVSSEETFEPSQELPAEALRDPSLQDALEVDLAVSVSQISIEEKVKELSPEEERRKWEEGRIDYMGKDAFARIQEKLDRFLQ

SEQ ID NO: 29472 - protein, 137 aa, Homo sapiens
  ENSP00000430764
MSVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSG

SEQ ID NO: 29473 - protein, 430 aa, Homo sapiens
  ENSP00000487294
MSETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 29474 - protein, 244 aa, Homo sapiens
  ENSP00000370549
  MOD_RES (1)..(1): Any amino acid
XLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDMIACPETETPAVITCDPLSQPSPQPADFTETETILVDLAVSVSQISIE

SEQ ID NO: 29475 - protein, 430 aa, Homo sapiens
  ENSP00000491962
FVETEFHHGAQAGLELLRSSNSPTSASQSAGMTVTDQAFVTLATNDIYCQGALVLGQSLRRHRLTRKLVVLITPQVSSLLRVILSKVFDEVIEVNLIDSADYIHLAFLKRPELGLTLTKLHCWTLTHYSKCVFLDADTLVLSNVDELFDRGEFSAAPDPGWPDCFNSGVFVFQPSLHTHKLLLQHAMEHGSFDGADQGLLNSFFRNWSTTDIHKHLPFIYNLSSNTMYTYSPAFKQFGSSAKVVHFLGSMKPWNYKYNPQSGSVLEQGSASSSQHQAAFLHLWWTVYQNNVLPLYKSVQAGEARASPGHTLCHSDVGGPCADSASGVGEPCENSTPSAGVPCANSPLGSNQPAQGLPEPTQIVDETLSLPEGRRSEDVDLAVSVSQISIEEKVKELSPEEERRKWEEGRIDYMGKDAFARIQEKLDRFLQ

SEQ ID NO: 29476 - protein, 737 aa, Homo sapiens
  ENSP00000317904
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 29477 - protein, 673 aa, Homo sapiens
  ENSP00000263276
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 29478 - protein, 113 aa, Homo sapiens
  ENSP00000470072
  MOD_RES (1)..(1): Any amino acid
XIYILDRRFRSLDDSCSQLTSFLYSFCQQSRRQRIIQRNRTERLSDLLDWKYLGRVGPPLSYPLLANQQLLARGLWCRVQGLILLVTVAVPLSNEPGRSRWWLMVVIPALWEA

SEQ ID NO: 29479 - protein, 711 aa, Homo sapiens
  ENSP00000338290
MESGAVLLESKSSPFNLLHEMHELRLLGHLCDVTVSVEYQGVRKDFMAHKAVLAATSKFFKEVFLNEKSVDGTRTNVYLNEVQVADFASFLEFVYTAKVQVEEDRVQRMLEVAEKLKCLDLSETCFQLKKQMLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEQVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 29480 - protein, 48 aa, Homo sapiens
  ENSP00000410009
MESGAVLLESKSSPFNLLHEMHELRLLGHLCDVTVSVEYQGVRKDFMA

SEQ ID NO: 29481 - protein, 711 aa, Homo sapiens; identical to SEQ ID NO: 29479
  ENSP00000366250

SEQ ID NO: 29482 - protein, 84 aa, Homo sapiens
  ENSP00000471894
MALSSQIWAACLLLLLLLASLTSGSVFPQQTGQLAELQPQDRAGARASWMPMFQRRRRRDTHFPICIFCCGCCHRSKCGMCCKT

SEQ ID NO: 29483 - protein, 84 aa, Homo sapiens; identical to SEQ ID NO: 29482
  ENSP00000222304

SEQ ID NO: 29484 - protein, 340 aa, Homo sapiens
  ENSP00000255039
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 29485 - protein, 185 aa, Homo sapiens
  ENSP00000388835
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQ

SEQ ID NO: 29486 - protein, 552 aa, Homo sapiens
  ENSP00000306991
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 29487 - protein, 890 aa, Homo sapiens
  ENSP00000307342
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 29488 - protein, 295 aa, Homo sapiens
  ENSP00000489134
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEVRCIFFFFKSIS

SEQ ID NO: 29489 - protein, 889 aa, Homo sapiens
  ENSP00000251287
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 29490 - protein, 1203 aa, Homo sapiens
  ENSP00000261917
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 29491 - protein, 64 aa, Homo sapiens
  ENSP00000362685
MEEPEEPADSGQSLVPVYIYSPEYVSMCDSLAKIPKRASMVHSLIEAYALHKQMRSWMRAVTSL

SEQ ID NO: 29492 - protein, 377 aa, Homo sapiens
  ENSP00000362674
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 29493 - protein, 248 aa, Homo sapiens
  ENSP00000362669
MEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTA

SEQ ID NO: 29494 - protein, 185 aa, Homo sapiens
  ENSP00000416489
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDVY

SEQ ID NO: 29495 - protein, 299 aa, Homo sapiens
  ENSP00000396424
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGK

SEQ ID NO: 29496 - protein, 56 aa, Homo sapiens
  ENSP00000400180
MEEPEEPADSGQSLVPVYIYSPEYVSMCDSLAKIPKRASMVHSLIEAYALHKQMRL

SEQ ID NO: 29497 - protein, 253 aa, Homo sapiens
  ENSP00000362672
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERALFIRTP

SEQ ID NO: 29498 - protein, 256 aa, Homo sapiens
  ENSP00000414486
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERYEPPAPNPGL

SEQ ID NO: 29499 - protein, 156 aa, Homo sapiens
  ENSP00000362661
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKYEPPAPNPGL

SEQ ID NO: 29500 - protein, 139 aa, Homo sapiens
  ENSP00000362660
MEEPEEPADSGQSLVPVYIYSPEYVSMCDSLAKIPKRASMVHSLIEAYALHKQMRDEASGFCYLNDAVLGILRLRRKFERILYVDLDLHHGDGTGDVSDVGLGKGRYYSVNVPIQDGIQDEKYYQICERYEPPAPNPGL

SEQ ID NO: 29501 - protein, 131 aa, Homo sapiens
  ENSP00000398997
MVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFE

SEQ ID NO: 29502 - protein, 158 aa, Homo sapiens
  ENSP00000362657
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKETCVYVALYKAF

SEQ ID NO: 29503 - protein, 146 aa, Homo sapiens
  ENSP00000362655
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKK

SEQ ID NO: 29504 - protein, 55 aa, Homo sapiens
  ENSP00000409778
MEEPEEPADSGQSLVPVYIYSPEYVSMCDSLAKIPKRASMVHSLIEAYALHKQMS

SEQ ID NO: 29505 - protein, 286 aa, Homo sapiens
  ENSP00000362691
MEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 29506 - protein, 259 aa, Homo sapiens
  ENSP00000300605
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGDDCRDDVGGAQDVGMLGILVKTGKYRASDEEKINPPPYLTCESFPHAVDHILQHLL

SEQ ID NO: 29507 - protein, 54 aa, Homo sapiens
  ENSP00000466602
MAACRALKAVLVDLSGTLHIEDAAVPGAQEALKRQAILQVQLTNMFVTWCFCNH

SEQ ID NO: 29508 - protein, 204 aa, Homo sapiens
  ENSP00000468067
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGLALGPGPFVTALEYATDTKATVVGKPEKTFFLEALRGTGCEPEEAVMIGD

SEQ ID NO: 29509 - protein, 146 aa, Homo sapiens
  ENSP00000466710
MAACRALKAVLVDLSGTLHIEDAAVPGAQEALKRFVTNTTKESKQDLLERLRKLEFDISEDEIFTSLTAARSLLERKQVRPMLLVDDRALPDFKGIQTSDPNAVVMGLAPEHFHYQILNQAFRLLLDGAPLIAIHKARYYKRKDGL

SEQ ID NO: 29510 - protein, 54 aa, Homo sapiens; identical to SEQ ID NO: 29507
  ENSP00000467309

SEQ ID NO: 29511 - protein, 132 aa, Homo sapiens
  ENSP00000467998
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAFR

SEQ ID NO: 29512 - protein, 132 aa, Homo sapiens; identical to SEQ ID NO: 29511
  ENSP00000467775

SEQ ID NO: 29513 - protein, 54 aa, Homo sapiens; identical to SEQ ID NO: 29507
  ENSP00000465829

SEQ ID NO: 29514 - protein, 131 aa, Homo sapiens
  ENSP00000466923
MAACRALKAVLVDLSGTLHIEDAAVPGAQEALKRLRGASVIIRFVTNTTKESKQDLLERLRKLEFDISEDEIFTSLTAARSLLERKQVRPMLLVDDRALPDFKGIQTSDPNAVVMGLAPEHFHYQILNQAF

SEQ ID NO: 29515 - protein, 122 aa, Homo sapiens
  ENSP00000465282
MAACRALKAVLVDLSGTLHIEDAAVPGAQEALKRFVTNTTKESKQDLLERLRKLEFDISEDEIFTSLTAARSLLERKQVRPMLLVDDRALPDFKGIQTSDPNAVVMGLAPEHFHYQILNQAF

SEQ ID NO: 29516 - protein, 189 aa, Homo sapiens
  ENSP00000014930
MLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSMQFGGYAKEADYVAQATRLRAALEGTATYRGDIYFCTGYDPPMKPYGRRNEIWLLKT

SEQ ID NO: 29517 - protein, 62 aa, Homo sapiens
  ENSP00000442020
KGIGMGMTVPISFAVFPNEDGSLQKKLKVWFRIPNQFQSDPPAPSDKSVKIEEREGITVYSI

SEQ ID NO: 29518 - protein, 133 aa, Homo sapiens
  ENSP00000441678
MLGMIKNSLFGSVETWPWQVLSKGDKEEVAYEERACEGGKFATVEVTDKPVDEALREAMPKVAKYAGGTNDKGIGMGMTVPISFAVFPNEDGSLQKKLKVWFRIPNQFQSDPPAPSDKSVKIEEREGITVYSM

SEQ ID NO: 29519 - protein, 543 aa, Homo sapiens
  ENSP00000356630
MPNPKNSKGGRKNKRANSSGDEQENGAGALAAAGAAGAAAGGALAAAAGCGAAAAGAPGAGGAAGAGGAGTGAANAAAAAGAAAAGDAKNEAPCATPLICSFGRPVDLEKDDYQKVVCNNEHCPCSTWMHLQCFYEWESSILVQFNCIGRARSWNEKQCRQNMWTKKGYDLAFRFCSCRCGQGHLKKDTDWYQVKRMQDEKKKKSGSEKNTGRPPGEAAEEAKKCRPPNKPQKGPSHDLPRRHSMDRQNSQEKAVGAAAYGARSPGGSPGQSPPTGYSILSPAHFSGPRSSRYLGEFLKNAIHLEPHKKAMAGGHVFRNAHFDYSPAGLAVHRGGHFDTPVQFLRRLDLSELLTHIPRHKLNTFHVRMEDDAQVGQGEDLRKFILAALSASHRNVVNCALCHRALPVFEQFPLVDGTLFLSPSRHDEIEYDVPCHLQGRLMHLYAVCVDCLEGVHKIICIKCKSRWDGSWHQLGTMYTYDILAASPCCQARLNCKHCGKPVIDVRIGMQYFSEYSNVQQCPHCGNLDYHFVKPFSSFKVLEAY

SEQ ID NO: 29520 - protein, 1606 aa, Homo sapiens
  ENSP00000379228
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREGECPILHNSQPVSQLPSLRPEHHHYPTIDEPLPPNWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 29521 - protein, 1572 aa, Homo sapiens
  ENSP00000407774
MLLHLCSVKNLYQNRFLGLAAMASPSRNSQSRRRCKEPLRYSYNPDQFHNMDLRGGPHDGVTIPRSTSDTDLVTSDSRSTLMVSSSYYSIGHSQDLVIHWDIKEEVDAGDWIGMYLIDEVLSENFLDYKNRGVNGSHRGQIIWKIDASSYFVEPETKICFKYYHGVSGALRATTPSVTVKNSAAPIFKSIGADETVQGQGSRRLISFSLSDFQAMGLKKGMFFNPDPYLKISIQPGKHSIFPALPHHGQERRSKIIGNTVNPIWQAEQFSFVSLPTDVLEIEVKDKFAKSRPIIKRFLGKLSMPVQRLLERHAIGDRVVSYTLGRRLPTDHVSGQLQFRFEITSSIHPDDEEISLSTEPESAQIQDSPMNNLMESGSGEPRSEAPESSESWKPEQLGEGSVPDGPGNQSIELSRPAEEAAVITEAGDQGMVSVGPEGAGELLAQVQKDIQPAPSAEELAEQLDLGEEASALLLEDGEAPASTKEEPLEEEATTQSRAGREEEEKEQEEEGDVSTLEQGEGRLQLRASVKRKSRPCSLPVSELETVIASACGDPETPRTHYIRIHTLLHSMPSAQGGSAAEEEDGAEEESTLKDSSEKDGLSEVDTVAADPSALEEDREEPEGATPGTAHPGHSGGHFPSLANGAAQDGDTHPSTGSESDSSPRQGGDHSCEGCDASCCSPSCYSSSCYSTSCYSSSCYSASCYSPSCYNGNRFASHTRFSSVDSAKISESTVFSSQDDEEEENSAFESVPDSMQSPELDPESTNGAGPWQDELAAPSGHVERSPEGLESPVAGPSNRREDWEARIDSHGRVFYVDHVNRTTTWQRPTAAATPDGMRRSGSIQQMEQLNRRYQNIQRTIATERSEEDSGSQSCEQAPAGGGGGGGSDSEAESSQSSLDLRREGSLSPVNSQKITLLLQSPAVKFITNPEFFTVLHANYSAYRVFTSSTCLKHMILKVRRDARNFERYQHNRDLVNFINMFADTRLELPRGWEIKTDQQGKSFFVDHNSRATTFIDPRIPLQNGRLPNHLTHRQHLQRLRSYSAGEASEVSRNRGASLLARPGHSLVAAIRSQHQHESLPLAYNDKIVAFLRQPNIFEMLQERQPSLARNHTLREKIHYIRTEGNHGLEKLSCDADLVILLSLFEEEIMSYVPLQAAFHPGYSFSPRCSPCSSPQNSPGLQRASARAPSPYRRDFEAKLRNFYRKLEAKGFGQGPGKIKLIIRRDHLLEGTFNQVMAYSRKELQRNKLYVTFVGEEGLDYSGPSREFFFLLSQELFNPYYGLFEYSANDTYTVQISPMSAFVENHLEWFRFSGRILGLALIHQYLLDAFFTRPFYKALLRLPCDLSDLEYLDEEFHQSLQWMKDNNITDILDLTFTVNEEVFGQVTERELKSGGANTQVTEKNKKEYIERMVKWRVERGVVQQTEALVRGFYEVVDSRLVSVFDARELELVIAGTAEIDLNDWRNNTEYRGGYHDGHLVIRWFWAAVERFNNEQRLRLLQFVTGTSSVPYEGFAALRGSNGLRRFCIEKWGKITSLPRAHTCFNRLDLPPYPSYSMLYEKLLTAVEETSTFGLE

SEQ ID NO: 29522 - protein, 138 aa, Homo sapiens
  ENSP00000413336
  MOD_RES (1)..(1): Any amino acid
XPRIPLQNGRLPNHLTHRQHLQRLRSYSAGEARVQWCDLGSLQPPPPRFKQFSCLSLSSSWDYRFRFSGRILGLALIHQYLLDAFFTRPFYKALLRLPCDLSDLEYLDEEFHQSLQWMKDNNITDILDLTFTVNEEVF

SEQ ID NO: 29523 - protein, 1381 aa, Homo sapiens
  ENSP00000311502
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 29524 - protein, 265 aa, Homo sapiens [sequence omitted]

SEQ ID NO: 29525 - protein, 63 aa, Homo sapiens
  ENSP00000417494
RKNKNDISKLIFKSGDFQMSPYAEYPKNPRSQEWGREAIEMHENGSTKNLLQMTDVYYSGAFF

SEQ ID NO: 29526 - protein, 416 aa, Homo sapiens
  ENSP00000298251
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSSLYIILSTGGIFLLVTLVTVCACWKPSKRKQKKLEKQNSLEYMDQNDDRLKPEADTLPRSGEQERKNPMALYILKDKDSPETEENPAPEPRSATEPGPPGYSVSPAVPGRSPGLPIRSARRYPRSPARSPATGRTHSSPPRAPSSPGRSRSASRTLRTAGVHIIREQDEAGPVEISA

SEQ ID NO: 29527 - protein, 391 aa, Homo sapiens
  ENSP00000409555
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 29528 - protein, 53 aa, Homo sapiens
  ENSP00000456384
MESETEPEPVTLLVKSPNQRHRDLELSGDRGWSVGHLKAHLSRVYPERPRTRG

SEQ ID NO: 29529 - protein, 232 aa, Homo sapiens
  ENSP00000340931
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 29530 - protein, 390 aa, Homo sapiens
  ENSP00000300302
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 29531 - protein, 366 aa, Homo sapiens
  ENSP00000369118
MESETEPEPVTLLVKSPNQRHRDLELSGDRGWSVGHLKAHLSRVYPERPRPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 29532 - protein, 150 aa, Homo sapiens
  ENSP00000457321
MVKNVLERPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHN

SEQ ID NO: 29533 - protein, 160 aa, Homo sapiens
  ENSP00000455094
MVKNVLERPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQ

SEQ ID NO: 29534 - protein, 109 aa, Homo sapiens
  ENSP00000457095
  MOD_RES (1)..(1): Any amino acid
XEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQ

SEQ ID NO: 29535 - protein, 226 aa, Homo sapiens
  ENSP00000455841
  MOD_RES (1)..(1): Any amino acid
XGQYPEDSSSDGLRQREVLRNLSSPGWENISSLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQKAPQPSQTDGVCAVAVGGFDRNGLDHLTPARLPLLDMAMMSF

SEQ ID NO: 29536 - protein, 150 aa, Homo sapiens
  ENSP00000457955
  MOD_RES (1)..(1): Any amino acid
XQQAFQGLGPGFSGYTPYGWLQLSWFQQIYARQYYMQYILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 29537 - protein, 280 aa, Homo sapiens
  ENSP00000232424
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPPGGAPCKLGSQAGEAAKVFGGFQVVPAPDGQFAFLIPNGAFAHSGPVIPVYTSNSGTSVGPNAVSPSSGPSLTADSMWRPWRN

SEQ ID NO: 29538 - protein, 186 aa, Homo sapiens
  ENSP00000367130
MEKKRRARINVSLEQLKSLLEKHYSHQIRKRKLEKADILELSVKYMRSLQNSLQGLWPVPRGAEQPSGFRSCLPGVSQLLRRGDEVGSGLRCPLVPESAAGSTMDSAGLGQEAPALFRPCTPAVWAPAPAAGGPRSPPPLLLLPESLPGSSASVPPPQPASSRCAESPGLGLRVWRPWGSPGDDLN

SEQ ID NO: 29539 - protein, 291 aa, Homo sapiens
  ENSP00000357349
MARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 29540 - protein, 337 aa, Homo sapiens
  ENSP00000357348
MKRPCEETTSESDMDETIDVGSENNYSGQSTSSVIRLNSPTTTSQIMARKKRRGIIEKRRRDRINNSLSELRRLVPTAFEKQGSAKLEKAEILQMTVDHLKMLQATGGKGYFDAHALAMDFMSIGFRECLTEVARYLSSVEGLDSSDPLRVRLVSHLSTCATQREAAAMTSSMAHHHHPLHPHHWAAAFHHLPAALLQPNGLHASESTPCRLSTTSEVPPAHGSALLTATFAHADSALRMPSTGSVAPCVPPLSTSLLSLSATVHAAAAAATAAAHSFPLSFAGAFPMLPPNAAAAVAAATAISPPLSVSATSSPQQTSSGTNNKPYRPWGTEVGAF

SEQ ID NO: 29541 - protein, 728 aa, Homo sapiens
  ENSP00000222390
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 29542 - protein, 723 aa, Homo sapiens
  ENSP00000391238
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 29543 - protein, 290 aa, Homo sapiens
  ENSP00000389854
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 29544 - protein, 285 aa, Homo sapiens
  ENSP00000408270
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 29545 - protein, 210 aa, Homo sapiens
  ENSP00000413829
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 29546 - protein, 58 aa, Homo sapiens
  ENSP00000395468
MSSGVKKEFGHEFDLYENKDYIRNCIIGKGRSYKGTVSITKSGIKCQPWSSMIPHEHR

SEQ ID NO: 29547 - protein, 141 aa, Homo sapiens
  ENSP00000396307
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVS

SEQ ID NO: 29548 - protein, 118 aa, Homo sapiens
  ENSP00000388592
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDL

SEQ ID NO: 29549 - protein, 184 aa, Homo sapiens
  ENSP00000346164
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSGGDDCLVESTFYSIPFWGHNSAR

SEQ ID NO: 29550 - protein, 124 aa, Homo sapiens
  ENSP00000401568
  MOD_RES (1)..(1): Any amino acid
XVLFGVVNTVACLDHLDPPQPPKCITALYVFAETHFDRGINDWLCKVRALFGAMNFWAIIMYNLVSLNSLKFTELVARRLLLTGFPQTTLSILFVTYCGVQLVKERERTLALEEEQKQDKEKPE

SEQ ID NO: 29551 - protein, 504 aa, Homo sapiens
  ENSP00000310621
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 29552 - protein, 504 aa, Homo sapiens; identical to SEQ ID NO: 29551
  ENSP00000405423

SEQ ID NO: 29553 - protein, 261 aa, Homo sapiens
  ENSP00000403787
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPK

SEQ ID NO: 29554 - protein, 231 aa, Homo sapiens
  ENSP00000395779
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQ

SEQ ID NO: 29555 - protein, 203 aa, Homo sapiens
  ENSP00000415351
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYS

SEQ ID NO: 29556 - protein, 116 aa, Homo sapiens
  ENSP00000413810
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKSGFVTGTFDLQEVLFHGGSS

SEQ ID NO: 29557 - protein, 117 aa, Homo sapiens
  ENSP00000408999
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPW

SEQ ID NO: 29558 - protein, 700 aa, Homo sapiens
  ENSP00000296575
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 29559 - protein, 320 aa, Homo sapiens
  ENSP00000408587
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFIYFCAGYVNFILVLPSSLKVFLCNKRKNLAGENKGAT

SEQ ID NO: 29560 - protein, 669 aa, Homo sapiens
  ENSP00000366898
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 29561 - protein, 600 aa, Homo sapiens
  ENSP00000244303
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 29562 - protein, 69 aa, Homo sapiens
  ENSP00000435532
MRPAAGAARRPRCCTSWLTRCPSPAASAPTWTRPLSCASPSATCACTASAPQGSGTRWEQGENHWMPAT

SEQ ID NO: 29563 - protein, 148 aa, Homo sapiens
  ENSP00000435200
MRPAAGAARRPRCCTSWLTRCPSPAASAPTWTRPLSCASPSATCACTASAPQATRMYPHFLGGAWEWNQVGAGGEPLDACYLKALEGFVMVLTAEGDMAYLSENVSKHLGLSQLELIGHSIFDFIHPCDQEELQDALTPQQTLSRRKV

SEQ ID NO: 29564 - protein, 450 aa, Homo sapiens
  ENSP00000434653
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDPSTPLLNLNEPLGFHFVTQSGVQWHKHSSPQPRPPGLK

SEQ ID NO: 29565 - protein, 69 aa, Homo sapiens; identical to SEQ ID NO: 29562
  ENSP00000432613

SEQ ID NO: 29566 - protein, 667 aa, Homo sapiens
  ENSP00000300862
MDWQDHRSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 29567 - protein, 69 aa, Homo sapiens; identical to SEQ ID NO: 29562
  ENSP00000469031

SEQ ID NO: 29568 - protein, 594 aa, Homo sapiens
  ENSP00000471560
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGFHFVTQSGVQWHKHSSPQPRPPGLK

SEQ ID NO: 29569 - protein, 93 aa, Homo sapiens
  ENSP00000434700
  MOD_RES (1)..(1): Any amino acid
XSEPPLQCLVLICEAIPHPGSLEPPLGRGAFLSRHSLDMKFTYCDDRNGDSGFSLLECQSWLCILSQMTSPLCATISSPILWNHNRTCLVQSF

SEQ ID NO: 29570 - protein, 81 aa, Homo sapiens
  ENSP00000432809
MALGLQRARSTTELRKEKSRDAARSRRSQETEVLYQLAHTLPFARGVSAHLDKASIMRLTISYLRMHRLCAAAGAHWTQHL

SEQ ID NO: 29571 - protein, 93 aa, Homo sapiens [sequence omitted]

SEQ ID NO: 29572 - protein, 93 aa, Homo sapiens [sequence omitted]

SEQ ID NO: 29573 - protein, 96 aa, Homo sapiens
  ENSP00000408289
MSTDTGVSLPSYEEDQGSKLIRKAKEAPFVPVGIAGFAAIVAYGLYKLKSRGNTKMSIHLIHMRVAAQGFVVGAMTVAFFFFRYGLFHVSGILGKT

SEQ ID NO: 29574 - protein, 107 aa, Homo sapiens
  ENSP00000398064
MEQKLVEEILQAITMSTDTGVSLPSYEEDQGSKLIRKAKEAPFVPVGIAGFAAIVAYGLYKLKSRGNTKMSIHLIHMRVAAQGFVVGAMTVGMGYSMYREFWAKPKP

SEQ ID NO: 29575 - protein, 1037 aa, Homo sapiens
  ENSP00000336747
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 29576 - protein, 986 aa, Homo sapiens
  ENSP00000410300
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 29577 - protein, 146 aa, Homo sapiens
  ENSP00000414280
MMFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGE

SEQ ID NO: 29578 - protein, 1008 aa, Homo sapiens
  ENSP00000484528
MMFPNPEPPPETVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 29579 - protein, 1068 aa, Homo sapiens
  ENSP00000253083
MNSIKNVPARVLSRRPGHSLEAEREQFDKTQAISISKAINTQEAPVKEKHARRIILGTHHEKGAFTFWSYAIGLPLPSSSILSWKFCHVLHKVLRDGHPNVLHDCQRYRSNIREIGDLWGHLHDRYGQLVNVYTKLLLTKISFHLKHPQFPAGLEVTDEVLEKAAGTDVNNIFQLTVEMFDYMDCELKLSESVFRQLNTAIAVSQMSSGQCRLAPLIQVIQDCSHLYHYTVKLLFKLHSCLPADTLQGHRDRFHEQFHSLRNFFRRASDMLYFKRLIQIPRLPEGPPNFLRASALAEHIKPVVVIPEEAPEDEEPENLIEISTGPPAGEPVVVADLFDQTFGPPNGSVKDDRDLQIESLKREVEMLRSELEKIKLEAQRYIAQLKSQVNALEGELEEQRKQKQKALVDNEQLRHELAQLRAAQLEGERSQGLREEAERKASATEARYNKLKEKHSELVHVHAELLRKNADTAKQLTVTQQSQEEVARVKEQLAFQVEQVKRESELKLEEKSDQLEKLKRELEAKAGELARAQEALSHTEQSKSELSSRLDTLSAEKDALSGAVRQREADLLAAQSLVRETEAALSREQQRSSQEQGELQGRLAERESQEQGLRQRLLDEQFAVLRGAAAEAAGILQDAVSKLDDPLHLRCTSSPDYLVSRAQEALDAVSTLEEGHAQYLTSLADASALVAALTRFSHLAADTIINGGATSHLAPTDPADRLIDTCRECGARALELMGQLQDQQALRHMQASLVRTPLQGILQLGQELKPKSLDVRQEELGAVVDKEMAATSAAIEDAVRRIEDMMNQARHASSGVKLEVNERILNSCTDLMKAIRLLVTTSTSLQKEIVESGRGAATQQEFYAKNSRWTEGLISASKAVGWGATQLVEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 29580 - protein, 197 aa, Homo sapiens
  ENSP00000446236
  MOD_RES (1)..(1): Any amino acid
XRHPLACRRRSWRAAGEAADKVVLHTGKYEELIVCSHEIAASTAQLVAASKVKANKHSPHLSRLQECSRTVNERAANVVASTKSGQEQIEDRDTMDFSGLSLIKLKKQEMETQVRVLELEKTLEAERMRLGELRKQHYVLAGASGSPGEEVAIRPSTAPRSVTTKKPPLAQKPSVAPRQDHQLDKKDGIYPAQLVNY

SEQ ID NO: 29581 - protein, 616 aa, Homo sapiens
  ENSP00000291823
MSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRNPHPDAANPWQLKSSADYLAETKVRPLERRKYMLKSLDQIETVNGGSVASRLTFPDREALAEHADLKSMVELIKRMLTWESHERISPSAALRHPFVSMQQLRSAHETTHYYQLSLRSYRLSLQVEGKPPTPVVAAEDGTPYYCLAEEKEAAGMGSVAGSSPFFREEKAPGMQRAIDQLDDLSLQEAGHGLWGETCTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 29582 - protein, 126 aa, Homo sapiens
  ENSP00000367008
MPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 29583 - protein, 126 aa, Homo sapiens; identical to SEQ ID NO: 29582
  ENSP00000289316

SEQ ID NO: 29584 - protein, 126 aa, Homo sapiens
  ENSP00000358151
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 29585 - protein, 126 aa, Homo sapiens
  ENSP00000358164
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 29586 - protein, 134 aa, Homo sapiens
  ENSP00000445831
MPDPAKSAPAPKKGSKKAVTKVQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSKLIGPILWK

SEQ ID NO: 29587 - protein, 917 aa, Homo sapiens
  ENSP00000290573
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 29588 - protein, 889 aa, Homo sapiens
  ENSP00000387140
MRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 29589 - protein, 282 aa, Homo sapiens
  ENSP00000423132
MCGRTSCHLPRDVLTRACAYQDRRGQQRLPEWRDPDKYCPSYNKSPQSNSPVLLSRLHFEKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGT

SEQ ID NO: 29590 - protein, 354 aa, Homo sapiens
  ENSP00000372955
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 29591 - protein, 312 aa, Homo sapiens
  ENSP00000392966
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 29592 - protein, 183 aa, Homo sapiens
  ENSP00000426276
MCGRTSCHLPRDVLTRACAYQDRRGQQRLPEWRDPDKYCPSYNKSPQSNSPVLLSRLHFEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLV

SEQ ID NO: 29593 - protein, 354 aa, Homo sapiens; identical to SEQ ID NO: 29590
  ENSP00000426215

SEQ ID NO: 29594 - protein, 354 aa, Homo sapiens; identical to SEQ ID NO: 29590
  ENSP00000374385

SEQ ID NO: 29595 - protein, 233 aa, Homo sapiens
  ENSP00000424594
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVS

SEQ ID NO: 29596 - protein, 140 aa, Homo sapiens
  ENSP00000421895
MCGRTSCHLPRDVLTRACAYQDRRGQQRLPEWRDPDKYCPSYNKSPQSNSPVLLSRLHFEKSGSIGAADSPENWEKVWDNWRLLTMAGIFDCWEPPEGGDVLYSYTIITVDSCKGLSDIHHRMPAILDGEEAVSKWLDFG

SEQ ID NO: 29597 - protein, 340 aa, Homo sapiens
  ENSP00000274901
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 29598 - protein, 370 aa, Homo sapiens
  ENSP00000381654
MGNVPSAVKHCLSYQQLLREHLWIGDSVAGALDPAQTSLLTNLHCFQPDVSGFSVSLAGTVACIHWETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 29599 - protein, 53 aa, Homo sapiens
  ENSP00000359889
MGNVPSAVKHCLSYQQLLREHLWIGDSVAGALDPAQELQSVMLMLHHGPLRKP

SEQ ID NO: 29600 - protein, 237 aa, Homo sapiens
  ENSP00000359887
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 29601 - protein, 174 aa, Homo sapiens
  ENSP00000424309
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMGINVVDSAVSGLGGCPYAKGASGNVATEDLIYMLNGLGLNTGVNLYKVMEAGDFICKAVNKTTNSKVAQASFNA

SEQ ID NO: 29602 - protein, 308 aa, Homo sapiens
  ENSP00000309737
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 29603 - protein, 151 aa, Homo sapiens
  ENSP00000412924
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYL

SEQ ID NO: 29604 - protein, 39 aa, Homo sapiens
  ENSP00000426054
MGNVPSAVKHCLSYQQLLREHLWIGDSVAGALDPAQEKE

SEQ ID NO: 29605 - protein, 888 aa, Homo sapiens [sequence omitted]

SEQ ID NO: 29606 - protein, 888 aa, Homo sapiens [sequence omitted]

SEQ ID NO: 29607 - protein, 835 aa, Homo sapiens
  ENSP00000340816
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 29608 - protein, 111 aa, Homo sapiens
  ENSP00000427340
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVI

SEQ ID NO: 29609 - protein, 18 aa, Homo sapiens
  ENSP00000409100
MLSRLFRMHGLFVASHPW

SEQ ID NO: 29610 - protein, 165 aa, Homo sapiens
  ENSP00000421378
  MOD_RES (1)..(1): Any amino acid
XHEYFPEMQILAVSGNYCTDKKPAAINWIEGRGKSVVCEAVIPAKVVREVLKTTTEAMIEVNINKNLVGSAMAGSIGGYNAHAANIVTAIYIACGQMLGVQGACKDNPGENARQLARIVCGTVMAGELSLMAALAAGHLVKSHMIHNRSKINLQDLQGACTKKTA

SEQ ID NO: 29611 - protein, 115 aa, Homo sapiens
  ENSP00000420871
YFPEMQILAVSGNYCTDKKPAAINWIEGRGKSVVCEAVIPAKVVREMLGVQGACKDNPGENARQLARIVCGTVMAGELSLMAALAAGHLVKSHMIHNRSKINLQDLQGACTKKTA

SEQ ID NO: 29612 - protein, 520 aa, Homo sapiens
  ENSP00000322706
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 29613 - protein, 520 aa, Homo sapiens; identical to SEQ ID NO: 29612
  ENSP00000399402

SEQ ID NO: 29614 - protein, 95 aa, Homo sapiens
  ENSP00000427339
MPGSLPLNAEACWPKDVGIVALEIYFPSQYVDQAELEKYDGVDAGKYTIGLGQAKMGFCTDREDINSLCMTVVQNLMERNNLSYDCIGRLEVGTE

SEQ ID NO: 29615 - protein, 48 aa, Homo sapiens
  ENSP00000288344
MPKRKVSSAEGAAKEEPKRRSARLSAKPPAKVEAKPKKAAAKILQTPK

SEQ ID NO: 29616 - protein, 45 aa, Homo sapiens
  ENSP00000395291
MPKRKVSSAEGAAKEEPKRRSARLSAKPPAKVEAKPKKAAAKVEV

SEQ ID NO: 29617 - protein, 100 aa, Homo sapiens
  ENSP00000370125
MPKRKVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 29618 - protein, 44 aa, Homo sapiens
  ENSP00000414421
MPKRKVSSAEGAAKEEPKRRSARLSAKPPAKVEAKPKKAAAKCR

SEQ ID NO: 29619 - protein, 90 aa, Homo sapiens
  ENSP00000370124
MPKRKVSSAEGAAKEEKPPAKVEAKPKKAAAKDKSSDKKVQTKGKRGAKGKQAEVANQETKEDLPAENGETKTEESPASDEAGEKEAKSD

SEQ ID NO: 29620 - protein, 45 aa, Homo sapiens; identical to SEQ ID NO: 29616
  ENSP00000396693

SEQ ID NO: 29621 - protein, 116 aa, Homo sapiens
  ENSP00000370123
MFEPNSPRRGGARYQWPEGAQVSSAEGAAKEEPKRRSARLSAKPPAKVEAKPKKAAAKDKSSDKKVQTKGKRGAKGKQAEVANQETKEDLPAENGETKTEESPASDEAGEKEAKSD

SEQ ID NO: 29622 - protein, 44 aa, Homo sapiens; identical to SEQ ID NO: 29618
  ENSP00000395787

SEQ ID NO: 29623 - protein, 354 aa, Homo sapiens
  ENSP00000334382
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHSSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 29624 - protein, 224 aa, Homo sapiens
  ENSP00000282260
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 29625 - protein, 177 aa, Homo sapiens
  ENSP00000426651
MGEQPIFSTRAHVFQIDPNTKKNWVPTSKHAVTVSYFYDSTRNVYRIISLDGSKAIINSTITPNMTFTKTSQKFGQWADSRANTVYGLGFSSEHHLSKFAEKFQEFKEAARLAKEKSQEKMELTSTPSQESAGGDLQSPLTPESINGTDDERTPDVTQNSEPRAEPTQNALPFSHRK

SEQ ID NO: 29626 - protein, 180 aa, Homo sapiens
  ENSP00000441587
MGSAISKHWEAELATLKGNNAKLTAALLESTANVKQWKQQLAAYQEEAERLHKRVTELECVSSQANAVHTHKTELNQTIQELEETLKLKEEEIERLKQEIDNARELQEQRDSLTQKLQEVEIRNKDLEGQLSDLEQRLEKSQNEQEAFRNNLKTLLEILDGKIFELTELRDNLAKLLECS

SEQ ID NO: 29627 - protein, 358 aa, Homo sapiens
  ENSP00000221222
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQTRNAELEHQLRAMERSLEEARAERERARAEVGRAAQLLDVSLFELSELREGLARLAEAAP

SEQ ID NO: 29628 - protein, 361 aa, Homo sapiens
  ENSP00000439937
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 29629 - protein, 361 aa, Homo sapiens; identical to SEQ ID NO: 29628
  ENSP00000376162

SEQ ID NO: 29630 - protein, 152 aa, Homo sapiens
  ENSP00000469800
MSTARQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 29631 - protein, 325 aa, Homo sapiens
  ENSP00000471835
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVSLFELSELREGLARLAEAAP

SEQ ID NO: 29632 - protein, 361 aa, Homo sapiens; identical to SEQ ID NO: 29628
  ENSP00000446026

SEQ ID NO: 29633 - protein, 243 aa, Homo sapiens
  ENSP00000472815
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVT

SEQ ID NO: 29634 - protein, 150 aa, Homo sapiens
  ENSP00000470659
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPG

SEQ ID NO: 29635 - protein, 85 aa, Homo sapiens
  ENSP00000472800
MSTAREQPIFSTRAHVFQIDPATKRNWIPAGKHALTVSYFYDATRNVYRIISIGGAKAIINSTVTPNMTFTKTSQKFGQWADSRA

SEQ ID NO: 29636 - protein, 358 aa, Homo sapiens; identical to SEQ ID NO: 29627
  ENSP00000396154

SEQ ID NO: 29637 - protein, 328 aa, Homo sapiens
  ENSP00000328598
MSSYLEYVSCSSSGGVGGDVLSLAPKFCRSDARPVALQPAFPLGNGDGAFVSCLPLAAARPSPSPPAAPARPSVPPPAAPQYAQCTLEGAYEPGAAPAAAAGGADYGFLGSGPAYDFPGVLGRAADDGGSHVHYATSAVFSGGGSFLLSGQVDYAAFGEPGPFPACLKASADGHPGAFQTASPAPGTYPKSVSPASGLPAAFSTFEWMKVKRNASKKGKLAEYGAASPSSAIRTNFSTKQLTELEKEFHFNKYLTRARRIEIANCLHLNDTQVKIWFQNRRMKQKKREREGLLATAIPVAPLQLPLSGTTPTKFIKNPGSPSQSQEPS

SEQ ID NO: 29638 - protein, 30 aa, Homo sapiens
  ENSP00000413689
MGKQNSKLRPEVLQDLRENTEFTDHELQEW

SEQ ID NO: 29639 - protein, 193 aa, Homo sapiens
  ENSP00000310749
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGKLSLEEFIRGAKSDPSIVRLLQCDPSSASQF

SEQ ID NO: 29640 - protein, 193 aa, Homo sapiens; identical to SEQ ID NO: 29639
  ENSP00000371184

SEQ ID NO: 29641 - protein, 175 aa, Homo sapiens
  ENSP00000416359
MGKQNSKLRPEVLQDLRENTEFTDHELQEWYKGFLKDCPTGHLTVDEFKKIYANFFPYGDASKFAEHVFRTFDTNGDGTIDFREFIIALSVTSRGKLEQKLKWAFSMYDLDGNGYISRSEMLEIVQAIYKMVSSVMKMPEDESTPEKRTDKIFRQMDTNNDGSAGWGRGCMCTPR

SEQ ID NO: 29642 - protein, 103 aa, Homo sapiens
  ENSP00000388856
  MOD_RES (1)..(1): Any amino acid
XLSVTSRGKLEQKLKWAFSMYDLDGNGYISRSEMLEIVQAIYKMVSSVMKMPEDESTPEKRTDKIFRQMDTNNDVSLGKPPMVTRCPNLPPGLALPTSSEGIF

SEQ ID NO: 29643 - protein, 193 aa, Homo sapiens; identical to SEQ ID NO: 29639
  ENSP00000482993

SEQ ID NO: 29644 - protein, 193 aa, Homo sapiens; identical to SEQ ID NO: 29639
  ENSP00000483786

SEQ ID NO: 29645 - protein, 193 aa, Homo sapiens; identical to SEQ ID NO: 29639
  ENSP00000478231

SEQ ID NO: 29646 - protein, 191 aa, Homo sapiens
  ENSP00000361935
MGKTNSKLAPEVLEDLVQNTEFSEQELKQWYKGFLKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 29647 - protein, 119 aa, Homo sapiens
  ENSP00000484070
MGKTNSKLAPEVLEDLVQNTEFSEQELKQWYKGFLKDCPSGILNLEEFQQLYIKAIYKMVGTVIMMRMNQDGLTPQQRVDKIFKKMDQDKDDQITLEEFKEAAKSDPSIVLLLQCDMQK

SEQ ID NO: 29648 - protein, 191 aa, Homo sapiens; identical to SEQ ID NO: 29646
  ENSP00000481834

SEQ ID NO: 29649 - protein, 417 aa, Homo sapiens
  ENSP00000262626
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 29650 - protein, 417 aa, Homo sapiens; identical to SEQ ID NO: 29649
  ENSP00000376060

SEQ ID NO: 29651 - protein, 80 aa, Homo sapiens
  ENSP00000472310
MAQKEGGRTVPCCSRPKVAALTAGTLLLLTAIGAASWAIVAVLLRSDQEPLYPVQVSSADARLMVFDKTEGTWRLLCSSR

SEQ ID NO: 29652 - protein, 259 aa, Homo sapiens
  ENSP00000470327
MAQKEVQVSSADARLMVFDKTEGTWRLLCSSRSNARVAGLSCEEMGFLRRNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 29653 - protein, 592 aa, Homo sapiens
  ENSP00000359583
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 29654 - protein, 534 aa, Homo sapiens
  ENSP00000359580
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 29655 - protein, 480 aa, Homo sapiens
  ENSP00000485916
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 29656 - protein, 548 aa, Homo sapiens
  ENSP00000359577
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKTQRCQYCGII

SEQ ID NO: 29657 - protein, 389 aa, Homo sapiens
  ENSP00000384384
ARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 29658 - protein, 149 aa, Homo sapiens
  ENSP00000484672
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYED

SEQ ID NO: 29659 - protein, 273 aa, Homo sapiens
  ENSP00000264735
MVRASCRLGSARTPSPARRPPGVRASQSRGGAAGTVSAWRRWCWRWPWRTAPSDGWRLPPGCLPGTDGVVPRPPAARSAAARPRETPGHTQLPPGARRRPRLESEMAFNDCFSLNYPGNPCPGDLIEVFRPGYQHWALYLGDGYVINIAPVDGIPASFTSAKSVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 29660 - protein, 111 aa, Homo sapiens
  ENSP00000414431
SVFSSKALVKMQLLKDVVGNDTYRINNKYDETYPPLPVEEIIKRSEFVIGQEVAYNLLVNNCEHFVTLLRYGEGVSEQANRAISTVEFVTAAVGVFSFLGLFPKGQRAKYY

SEQ ID NO: 29661 - protein, 397 aa, Homo sapiens
  ENSP00000366506
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDRPWLCLPECWSVELTHSFIHLFIHSFANIHPIPTTCQEL

SEQ ID NO: 29662 - protein, 363 aa, Homo sapiens
  ENSP00000490705
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDREFGE

SEQ ID NO: 29663 - protein, 422 aa, Homo sapiens
  ENSP00000489742
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDRKPALSCTTCSSNLLSCCKSLWGLRFLQRHMGGPSEELSGEPLSEEPQKRPPQKAVRTLPSEAV

SEQ ID NO: 29664 - protein, 359 aa, Homo sapiens
  ENSP00000231683
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 29665 - protein, 445 aa, Homo sapiens
  ENSP00000342560
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 29666 - protein, 373 aa, Homo sapiens
  ENSP00000321482
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRKVAKSLAVIVSIFGLCWAPYTLLMIIRAACHGHCVPDYWYETSFWLLWANSAVNPVLYPLCHHSFRRAFTKLLCPQKLKIQPHSSLEHCWKKMKKKTCL

SEQ ID NO: 29667 - protein, 200 aa, Homo sapiens
  ENSP00000482567
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAPAAPRGALRGRAHSRGAPSRRRPRPRWRSA

SEQ ID NO: 29668 - protein, 307 aa, Homo sapiens
  ENSP00000002596
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 29669 - protein, 82 aa, Homo sapiens
  ENSP00000425673
MAALLLGAVLLVAQPQLVPSRPAELGQQELLRKAGTLQDDVRDGVAPNGSAQQLPQTIIIGVRKGGTRALLEMLSLHPDVAA

SEQ ID NO: 29670 - protein, 82 aa, Homo sapiens; identical to SEQ ID NO: 29669
  ENSP00000422629

SEQ ID NO: 29671 - protein, 367 aa, Homo sapiens
  ENSP00000261374
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 29672 - protein, 162 aa, Homo sapiens
  ENSP00000454505
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYR

SEQ ID NO: 29673 - protein, 456 aa, Homo sapiens
  ENSP00000330606
MARWPAPPPPPPPPPPLAAPPPPGASAKGPPARKLLFMCTLSLSVTYLCYSLLGGSGSLQFPLALQESPGAAAEPPPSPPPPSLLPTPVRLGAPSQPPAPPPLDNASHGEPPEPPEQPAAPGTDGWGLPSGGGGAQDAWLRTPLAPSEMITAQSALPEREAQESSTTDEDLAGRRAANGSSERGGAVSTPDYGEKKLPQALIIGVKKGGTRALLEAIRVHPDVRAVGVEPHFFDRNYEKGLEWYRNVMPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 29674 - protein, 605 aa, Homo sapiens
  ENSP00000359873
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 29675 - protein, 645 aa, Homo sapiens
  ENSP00000429473
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 29676 - protein, 645 aa, Homo sapiens; identical to SEQ ID NO: 29675
  ENSP00000359870

SEQ ID NO: 29677 - protein, 605 aa, Homo sapiens; identical to SEQ ID NO: 29674
  ENSP00000384013

SEQ ID NO: 29678 - protein, 277 aa, Homo sapiens
  ENSP00000491722
MLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTRCVPHIWNWEQSFSISYNRWRIFQILDAASKDKRGSPNTNAGANSPSSTKTRNTSKSGKNFHYITILRDPVSRYLSEWRHVQRGATWKASLHVCDGRPPTSEELPSCYTGDDWSGCPLKEFMDCPYNLANNRQCACSPT

SEQ ID NO: 29679 - protein, 300 aa, Homo sapiens
  ENSP00000351035
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 29680 - protein, 256 aa, Homo sapiens
  ENSP00000423775
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 29681 - protein, 312 aa, Homo sapiens
  ENSP00000278353
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 29682 - protein, 57 aa, Homo sapiens
  ENSP00000490749
MAPRAGFRPKVVSEQRLLVSSSPSRPAPPPGFIHSLFSFTKLSQVVLMELENHMQKS

SEQ ID NO: 29683 - protein, 164 aa, Homo sapiens
  ENSP00000436582
MESALPAAGFLYWVGAGTVAYLALRISYSLFTALRVWGVGNEAGVGPGLGEWAEEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSAT

SEQ ID NO: 29684 - protein, 103 aa, Homo sapiens
  ENSP00000490822
MESALPAAGFLYWVGAGTVAYLALRISYSLFTALRVWGVGNEAGVGPGLGEWADDTIGTAWHGGKIQRGYSEHFIWQWHAPCPTLDHLFCNQDFCRFLLSVPP

SEQ ID NO: 29685 - protein, 98 aa, Homo sapiens
  ENSP00000379052
MESALPAAGFLYWVGAGTVAYLALRISYSLFTALRVWGVGNEAGVGPGLGEWAVVTGSTDGIGKSYAEELAKHGMKVVLISRSKDKLDQVSSEISNYT

SEQ ID NO: 29686 - protein, 111 aa, Homo sapiens
  ENSP00000490003
MESALPAAGFLYWVGAGTVAYLALRISYSLFTALRVWGVGNEAGVGPGLGEWAGESDAAPRPRSRGGPDQAWAVMTSSGVCSWPSPPQLSSFSGSCAPRAPPGSLGCLLLA

SEQ ID NO: 29687 - protein, 276 aa, Homo sapiens
  ENSP00000490421
MESALPAAGFLYWVGAGTVAYLALRISYSLFTALRVWGVGNEAGVGPGLGEWAVVTGSTDGIGKSYAEELAKHGMKVVLISRSKDKLDQVSSEIMNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 29688 - protein, 178 aa, Homo sapiens
  ENSP00000490701
MEPVSRPAASSVTRCPPWFAPFVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVD

SEQ ID NO: 29689 - protein, 732 aa, Homo sapiens
  ENSP00000216281
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 29690 - protein, 854 aa, Homo sapiens
  ENSP00000335153
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 29691 - protein, 52 aa, Homo sapiens
  ENSP00000451400
  MOD_RES (1)..(1): Any amino acid
XVETFAFQAEIAQLMSLIINTFYSNKEIFLRELISNSSDVNLWVVEQKLSYT

SEQ ID NO: 29692 - protein, 174 aa, Homo sapiens
  ENSP00000450712
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGEPMGRGTKVILHLKEDQTEYLEERRIKEIVKKHSQFIGYPITLFVEKERDKEVSDDEAEEKEDKEE

SEQ ID NO: 29693 - protein, 80 aa, Homo sapiens
  ENSP00000452241
MPPCSGGDGSTPPGPSLRDRDCPAQSAEYPRDRLDPRPGSPSEASSPPFLRRCLRKPRPKTNRWRRRRLRRSPFRQKLPS

SEQ ID NO: 29694 - protein, 100 aa, Homo sapiens
  ENSP00000489370
MPPCSGGDGSTPPGPSLRDRDCPAQSAEYPRDRLDPRPGSPSEASSPPFLRRAPVNWYQEKAQVFLWHLMVSGSTTLLCLWKQPFHVSAFPVTASLAFRQ

SEQ ID NO: 29695 - protein, 724 aa, Homo sapiens
  ENSP00000360709
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 29696 - protein, 724 aa, Homo sapiens; identical to SEQ ID NO: 29695
  ENSP00000325875

SEQ ID NO: 29697 - protein, 724 aa, Homo sapiens; identical to SEQ ID NO: 29695
  ENSP00000360609

SEQ ID NO: 29698 - protein, 724 aa, Homo sapiens; identical to SEQ ID NO: 29695
  ENSP00000481908

SEQ ID NO: 29699 - protein, 641 aa, Homo sapiens
  ENSP00000408907
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 29700 - protein, 476 aa, Homo sapiens
  ENSP00000393259
MAKAAAIGIDLGTTYSCVGVFQHGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 29701 - protein, 641 aa, Homo sapiens
  ENSP00000382915
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGDTKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 29702 - protein, 476 aa, Homo sapiens; identical to SEQ ID NO: 29700
  ENSP00000372880

SEQ ID NO: 29703 - protein, 641 aa, Homo sapiens; identical to SEQ ID NO: 29699
  ENSP00000404524

SEQ ID NO: 29704 - protein, 476 aa, Homo sapiens; identical to SEQ ID NO: 29700
  ENSP00000415927

SEQ ID NO: 29705 - protein, 641 aa, Homo sapiens; identical to SEQ ID NO: 29699
  ENSP00000364802

SEQ ID NO: 29706 - protein, 476 aa, Homo sapiens; identical to SEQ ID NO: 29700
  ENSP00000477378

SEQ ID NO: 29707 - protein, 641 aa, Homo sapiens; identical to SEQ ID NO: 29699
  ENSP00000406359

SEQ ID NO: 29708 - protein, 476 aa, Homo sapiens; identical to SEQ ID NO: 29700
  ENSP00000410693

SEQ ID NO: 29709 - protein, 641 aa, Homo sapiens; identical to SEQ ID NO: 29699
  ENSP00000403530

SEQ ID NO: 29710 - protein, 641 aa, Homo sapiens; identical to SEQ ID NO: 29699
  ENSP00000364801

SEQ ID NO: 29711 - protein, 641 aa, Homo sapiens; identical to SEQ ID NO: 29699
  ENSP00000375399

SEQ ID NO: 29712 - protein, 642 aa, Homo sapiens
  ENSP00000402651
GMAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 29713 - protein, 641 aa, Homo sapiens; identical to SEQ ID NO: 29699
  ENSP00000393087

SEQ ID NO: 29714 - protein, 642 aa, Homo sapiens; identical to SEQ ID NO: 29712
  ENSP00000387691

SEQ ID NO: 29715 - protein, 641 aa, Homo sapiens; identical to SEQ ID NO: 29699
  ENSP00000375391

SEQ ID NO: 29716 - protein, 642 aa, Homo sapiens; identical to SEQ ID NO: 29712
  ENSP00000442789

SEQ ID NO: 29717 - protein, 840 aa, Homo sapiens
  ENSP00000302961
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 29718 - protein, 475 aa, Homo sapiens [sequence omitted]

SEQ ID NO: 29719 - protein, 699 aa, Homo sapiens [sequence omitted]

SEQ ID NO: 29720 - protein, 839 aa, Homo sapiens
  ENSP00000422482
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 29721 - protein, 839 aa, Homo sapiens; identical to SEQ ID NO: 29720
  ENSP00000296464

SEQ ID NO: 29722 - protein, 531 aa, Homo sapiens
  ENSP00000427305
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTL

SEQ ID NO: 29723 - protein, 813 aa, Homo sapiens
  ENSP00000425645
MKPILLFMERACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVLVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSEHNGPMDGQSGTETKSDSTKDSSQHTKSSGEMEVD

SEQ ID NO: 29724 - protein, 646 aa, Homo sapiens
  ENSP00000437125
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 29725 - protein, 500 aa, Homo sapiens
  ENSP00000437189
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 29726 - protein, 646 aa, Homo sapiens; identical to SEQ ID NO: 29724
  ENSP00000432083

SEQ ID NO: 29727 - protein, 493 aa, Homo sapiens
  ENSP00000404372
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGMPGGMPGGFPGGGAPPSGGASSGPTIEEVD

SEQ ID NO: 29728 - protein, 646 aa, Homo sapiens; identical to SEQ ID NO: 29724
  ENSP00000227378

SEQ ID NO: 29729 - protein, 410 aa, Homo sapiens
  ENSP00000433316
MVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 29730 - protein, 627 aa, Homo sapiens
  ENSP00000433584
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 29731 - protein, 223 aa, Homo sapiens
  ENSP00000435908
MTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPP

SEQ ID NO: 29732 - protein, 150 aa, Homo sapiens
  ENSP00000435019
MTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKE

SEQ ID NO: 29733 - protein, 312 aa, Homo sapiens
  ENSP00000432884
MNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYG

SEQ ID NO: 29734 - protein, 168 aa, Homo sapiens
  ENSP00000436762
MSKGPAVGIDLGTTYSCVGVFQHGKVEIIANDQGNRTTPSYVAFTDTERLIGDAAKNQVAMNPTNTVFETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSI

SEQ ID NO: 29735 - protein, 187 aa, Homo sapiens
  ENSP00000435154
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDK

SEQ ID NO: 29736 - protein, 183 aa, Homo sapiens
  ENSP00000431641
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAY

SEQ ID NO: 29737 - protein, 178 aa, Homo sapiens
  ENSP00000436183
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTA

SEQ ID NO: 29738 - protein, 171 aa, Homo sapiens
  ENSP00000434415
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLR

SEQ ID NO: 29739 - protein, 137 aa, Homo sapiens
  ENSP00000434565
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGK

SEQ ID NO: 29740 - protein, 132 aa, Homo sapiens
  ENSP00000434851
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAE

SEQ ID NO: 29741 - protein, 679 aa, Homo sapiens
  ENSP00000297185
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 29742 - protein, 102 aa, Homo sapiens
  ENSP00000421892
  MOD_RES (1)..(1): Any amino acid
XTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKRFPK

SEQ ID NO: 29743 - protein, 163 aa, Homo sapiens
  ENSP00000429475
  MOD_RES (1)..(1): Any amino acid
XDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKEICKKKKNEPGKKRSWTRWMPHILRNPRGRVQWLTPVIPALWEAKAGGSRGSADCTGSFWQSPK

SEQ ID NO: 29744 - protein, 100 aa, Homo sapiens
  ENSP00000421311
  MOD_RES (1)..(1): Any amino acid
XVLLHLSAMISASRAAAARLVGAAASRGPTAARHQDSWNGLSHEAFRLVSRRDYASEAIKGAVVGIDLGTTNSCVAVMEGAGECRRCQNHPFSCGLYSRW

SEQ ID NO: 29745 - protein, 42 aa, Homo sapiens
  ENSP00000423759
MISASRAAAARLVGAAASRGPTAARHQDTHWLVTESVFSFLG

SEQ ID NO: 29746 - protein, 38 aa, Homo sapiens
  ENSP00000420944
MISASRAAAARLVGAAASRGPTAARHQIRSNQGSSCWY

SEQ ID NO: 29747 - protein, 95 aa, Homo sapiens
  ENSP00000425598
MEGKQAKVLENAEGARTTPSVVAFTADGERLVGMPAKRQAVTNPNNTFYATKRLIGRRYDDPEVQKDIKNVPFKIVRASNGDAWVEAHGKLYSPS

SEQ ID NO: 29748 - protein, 62 aa, Homo sapiens
  ENSP00000423098
MEGKQAKVLENAEGARTTPSVVAFTADGERLVGMPAKRQAVTNPNNTFYATKRLIGRRYDDP

SEQ ID NO: 29749 - protein, 205 aa, Homo sapiens
  ENSP00000248553
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 29750 - protein, 186 aa, Homo sapiens [sequence omitted]

SEQ ID NO: 29751 - protein, 37 aa, Homo sapiens
  ENSP00000405285
MPKLATQSNEITIPVTFESRAQLGGPEAAKSDETAAK

SEQ ID NO: 29752 - protein, 573 aa, Homo sapiens
  ENSP00000373620
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 29753 - protein, 234 aa, Homo sapiens [sequence omitted]

SEQ ID NO: 29754 - protein, 221 aa, Homo sapiens
  ENSP00000412717
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDR

SEQ ID NO: 29755 - protein, 48 aa, Homo sapiens
  ENSP00000390404
MLRLPTVFRQMRPVSRVLAPHLTRAYAKDVKFGADARALMLQGKNSDY

SEQ ID NO: 29756 - protein, 175 aa, Homo sapiens
  ENSP00000414446
MKTCWTREQLQGKRQGEVVKGKQGGEYRHPDPARQAGWQETEMLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISK

SEQ ID NO: 29757 - protein, 94 aa, Homo sapiens
  ENSP00000396460
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIG

SEQ ID NO: 29758 - protein, 83 aa, Homo sapiens
  ENSP00000402478
MLRLPTVFRQMRPVSRVLAPHLTRAYAKDVKFGADARALMLQGVDLLADAVAVTMGPKGRTVIIEQSWGSPKVTKDGVTVAKS

SEQ ID NO: 29759 - protein, 58 aa, Homo sapiens
  ENSP00000412227
MLRLPTVFRQMRPVSRVLAPHLTRAYAKDVKFGADARALMLQGVDLLADAVAVTMGPK

SEQ ID NO: 29760 - protein, 573 aa, Homo sapiens; identical to SEQ ID NO: 29752
  ENSP00000340019

SEQ ID NO: 29761 - protein, 261 aa, Homo sapiens
  ENSP00000474534
MAGQAFRKFLPLFDRVLVERSAAETVTKGGIMLPEKSQGKVLQATVVAVGSGSKGKDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 29762 - protein, 858 aa, Homo sapiens
  ENSP00000318687
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 29763 - protein, 115 aa, Homo sapiens
  ENSP00000408991
DEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNDSCGIVNSY

SEQ ID NO: 29764 - protein, 860 aa, Homo sapiens
  ENSP00000487365
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 29765 - protein, 814 aa, Homo sapiens
  ENSP00000369768
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 29766 - protein, 115 aa, Homo sapiens
  ENSP00000473512
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKSPPSLQMLRGDLC

SEQ ID NO: 29767 - protein, 782 aa, Homo sapiens
  ENSP00000396090
MATAAVLRGPAAHWVESFQKAREEGSGSGTWRGRWRRRSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVLGTAFDPFLGGKNFDEKLVEHFCAEFKTKYKLDAKSKIRALLRLYQECEKLKKLMSSNSTDLPLNIECFMNDKDVSGKMNRSQFEELCAELLQKIEVPLYSLLEQTHLKVEDVSAVEIVGGATRIPAVKERIAKFFGKDISTTLNADEAVARGCALQCAILSPAFKVREFSVTDAVPFPISLIWNHDSEDTEGVHEVFSRNHAAPFSKVLTFLRRGPFELEAFYSDPQGVPYPEAKIGRFVVQNVSAQKDGEKSRVKVKVRVNTHGIFTISTASMVEKVPTEENEMSSEADMECLNQRPPENPDTDKNVQQDNSEAGTQPQVQTDAQQTSQSPPSPELTSEENKIPDADKANEKKVDQPPEAKKPKIKVVNVELPIEANLVWQLGKDLLNMYIETEGKMIMQDKLEKERNDAKNAVEEYVYEFRDKLCGPYEKFICEQDHQNFLRLLTETEDWLYEEGEDQAKQAYVDKLEELMKIGTPVKVRFQEAEERPKMFEELGQRLQHYAKIAADFRNKDEKYNHIDESEMKKVEKSVNEVMEWMNNVMNAQAKKSLDQDPVVRAQEIKTKIKELNNTCEPVVTQPKPKIESPKLERTPNGPNIDKKEEDLEDKNNFGAEPPHQNGECYPNEKNSVNMDLD

SEQ ID NO: 29768 - protein, 390 aa, Homo sapiens
  ENSP00000358963
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 29769 - protein, 471 aa, Homo sapiens
  ENSP00000367959
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 29770 - protein, 110 aa, Homo sapiens
  ENSP00000482708
FNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGEWH

SEQ ID NO: 29771 - protein, 387 aa, Homo sapiens
  ENSP00000441861
MQFLKSAKQKPNYYHIMLVEDQEEGTLHQFNYCERCSESQNNKCISCVDPEDKWYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 29772 - protein, 471 aa, Homo sapiens; identical to SEQ ID NO: 29769
  ENSP00000437737

SEQ ID NO: 29773 - protein, 458 aa, Homo sapiens
  ENSP00000361019
MVNLRNAVHSFLVHLIGLLVWQSDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 29774 - protein, 458 aa, Homo sapiens; identical to SEQ ID NO: 29773
  ENSP00000276198

SEQ ID NO: 29775 - protein, 248 aa, Homo sapiens
  ENSP00000361018
MVNLRNAVHSFLVHLIGLLVWQSDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRCISSYPCDWTEGRRKGVREQHDVRAQRPKFRSYWVLRSFLHTADDYGDYVLPDHLRSAPTSFDVTARPHRGTAWTKSGFPEVLQEEYGRGRELCKP

SEQ ID NO: 29776 - protein, 357 aa, Homo sapiens
  ENSP00000287907
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 29777 - protein, 480 aa, Homo sapiens
  ENSP00000357980
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 29778 - protein, 221 aa, Homo sapiens
  ENSP00000412676
GKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 29779 - protein, 714 aa, Homo sapiens
  ENSP00000270112
MPAAAGDGLLGEPAAPGGGGGAEDAARPAAACEGSFLPAWVSGVPRERLRDFQHHKRVGNYLIGSRKLGEGSFAKVREGLHVLTGEKVAIKVIDKKRAKKDTYVTKNLRREGQIQQMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSIGVNMYAMLTGTLPFTVEPFSLRALYQKMVDKEMNPLPTQLSTGAISFLRSLLEPDPVKRPNIQQALANRWLNENYTGKVPCNVTYPNRISLEDLSPSVVLHMTEKLGYKNSDVINTVLSNRACHILAIYFLLNKKLERYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKDSFGCRNIFRKTSDSNCVASSSMEFIPVPPPRTPRIVKKPEPHQPGPGSTGIPHKEDPLMLDMVRSFESVDRDDHVEVLSPSHHYRILNSPVSLARRNSSERTLSPGLPSGSMSPLHTPLHPTLVSFAHEDKNSPPKEEGLCCPPPVPSNGPMQPLGSPNCVKSRGRFPMMGIGQMLRKRHQSLQPSADRPLEASLPPLQPLAPVNLAFDMADGVKTQC

SEQ ID NO: 29780 - protein, 162 aa, Homo sapiens
  ENSP00000411860
QMIRHPNITQLLDILETENSYYLVMELCPGGNLMHKIYEKKRLEESEARRYIRQLISAVEHLHRAGVVHRDLKIENLLLDEDNNIKLIDFGLSNCAGILGYSDPFSTQCGSPAYAAPELLARKKYGPKIDVWSMCHQFPALSPGTGSCEEAKYSAGTGESLA

SEQ ID NO: 29781 - protein, 112 aa, Homo sapiens
  ENSP00000408219
RYLSGKSDIQDSLCYKTRLYQIEKYRAPKESYEASLDTWTRDLEFHAVQDKKPKEQEKRGDFLHRPFSKKLDKNLPSHKQPSGSLMTQIQNTKALLKDRKASKSSFPDKGLS

SEQ ID NO: 29782 - protein, 924 aa, Homo sapiens
  ENSP00000221980
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 29783 - protein, 78 aa, Homo sapiens
  ENSP00000464796
MPLPPWQPVGENFTLSCRVPGAGPRASLTLTLLRGAQELIRRSFAGEPPRARGAVLTATVLARREDHGANFSCRAELD

SEQ ID NO: 29784 - protein, 284 aa, Homo sapiens
  ENSP00000343552
MAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 29785 - protein, 116 aa, Homo sapiens
  ENSP00000466222
MAGCAARAPPGSEARLSLATFLLGASVLALPLLTRAGLQGRTGLALYVAGLNALLLLLYRPPRYQIAIRACFLGFVFGCGTLLSFSQSSWSHFGWSHLVHPHSHCRIFPYTMISVP

SEQ ID NO: 29786 - protein, 94 aa, Homo sapiens
  ENSP00000467999
MAGCAARAPPGSEARLSLATFLLGASVLALPLLTRAGLQGRTGLALYVAGLNALLLLLYRPPRYQIAIRACFLGFVFGCGTLLSFSQSSWSHFG

SEQ ID NO: 29787 - protein, 309 aa, Homo sapiens
  ENSP00000339477
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 29788 - protein, 302 aa, Homo sapiens
  ENSP00000384432
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 29789 - protein, 473 aa, Homo sapiens
  ENSP00000383230
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGEFAVGSSRFWGAQGRLGCQLSFRVSKNFQKAKVPCLEQLLFLETQRSPRWCAWHFLQPPLGMGWHPGVHFVTLRWDFPNMHRSRETSARPPRSPVPSPDQGVQGGSRHRRPAPMGCPEWVQAPAPSPRGVSRAGPGTGAQPLWGVRSGSGHRQLLSVAATPAALVCPSVPGAT

SEQ ID NO: 29790 - protein, 185 aa, Homo sapiens
  ENSP00000383228
MRLGSPGLLFLLFSSLRAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 29791 - protein, 134 aa, Homo sapiens
  ENSP00000234091
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 29792 - protein, 134 aa, Homo sapiens; identical to SEQ ID NO: 29791
  ENSP00000385465

SEQ ID NO: 29793 - protein, 134 aa, Homo sapiens; identical to SEQ ID NO: 29791
  ENSP00000379585

SEQ ID NO: 29794 - protein, 161 aa, Homo sapiens
  ENSP00000367972
MKAVSPVRPSGRKAPSGCGGGELALRCLAEHGHSLGGSAAAAAAAAAARCKAAEAAADEPALCLQCDMNDCYSRLRRLVPTIPPNKKVSKVEILQHVIDYILDLQLALETHPALLRQPPPPAPPHHPAGTCPAAPPRTPLTALNTDPAGAVNKQGDSILCR

SEQ ID NO: 29795 - protein, 284 aa, Homo sapiens
  ENSP00000370748
MWRGLALARAIGCAARGRGQWAVRAADCAQSGRHPGPAVVCGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 29796 - protein, 120 aa, Homo sapiens
  ENSP00000404771
MELDLFLGLDDVFPRLLHGLLHRAFSVFLFNTENKLLLQQRSDAKITFPGCFTNTCCSHPLSNPAELEESDALGVRRAAQRRLKAELGIPLEEVTSSPTQPYKLKPKHTIKRFLIKFLNS

SEQ ID NO: 29797 - protein, 122 aa, Homo sapiens
  ENSP00000401879
MPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEE

SEQ ID NO: 29798 - protein, 255 aa, Homo sapiens
  ENSP00000436261
MSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29799 - protein, 562 aa, Homo sapiens
  ENSP00000337593
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29800 - protein, 264 aa, Homo sapiens
  ENSP00000432493
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRCFYRVK

SEQ ID NO: 29801 - protein, 559 aa, Homo sapiens
  ENSP00000380052
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQVPSMGGRKRERKAAVEEDTSLSESEGPRQPDGDEEESTALSINEEMQRMLNQLREYDFEDDCDSLTWEETEETLLLWEDFSGYAMAAAEAQGEQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29802 - protein, 563 aa, Homo sapiens
  ENSP00000349364
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29803 - protein, 571 aa, Homo sapiens
  ENSP00000482285
MNPLFGPNLFLLQQEQQGLAGPLGDSLGGDHFAGGGDLPPAPLSPAGPAAYSPPGPGPAPPAAMALRNDLGSNINVLKTLNLRFRCFLAKVHELERRNRLLEKQLQQALEEGKQGRRGLGRRDQAVQTGFVSPIRPLGLQLGARPAAVCSPSARVLGSPARSPAGPLAPSAASLSSSSTSTSTTYSSSARFMPGTIWSFSHARRLGPGLEPTLVQGPGLSWVHPDGVGVQIDTITPEIRALYNVLAKVKRERDEYKRRWEEEYTVRIQLQDRVNELQEEAQEADACQEELALKVEQLKAELVVFKGLMSNNLSELDTKIQEKAMKVDMDICRRIDITAKLCDVAQQRNCEDMIQMFQKKLSLHLSPIKVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29804 - protein, 256 aa, Homo sapiens
  ENSP00000390721
MSNNLSELDTKIQEKAMKVDMDICRRIDITAKLCDVAQQRNCEDMIQMFQKKLVPSMGGRKRERKAAVEEDTSLSESEGPRQPDGDEEESTALSINEEMQRMLNQLREYDFEDDCDSLTWEETEETLLLWEDFSGYAMAAAEAQGEQQEDSLEKVIKDTESLFKTREKEYQETIDQIELELATAKNDMNRHLHEYMEMCSMKRGLDVQMETCRRLITQSGDRKSPAFTAVPLSDPPPPPSEAEDSDRDVSSDSSMR

SEQ ID NO: 29805 - protein, 256 aa, Homo sapiens; identical to SEQ ID NO: 29804
  ENSP00000482340

SEQ ID NO: 29806 - protein, 520 aa, Homo sapiens
  ENSP00000327824
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 29807 - protein, 244 aa, Homo sapiens
  ENSP00000328994
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPGLFWTHTPCGNLSAQQTRVRE

SEQ ID NO: 29808 - protein, 491 aa, Homo sapiens
  ENSP00000363542
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 29809 - protein, 185 aa, Homo sapiens
  ENSP00000363540
MMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALV

SEQ ID NO: 29810 - protein, 211 aa, Homo sapiens
  ENSP00000363539
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKVGSSFPAPRLGPLLHPFLLRFFSPSQPAPAPLLQEVFPVHS

SEQ ID NO: 29811 - protein, 30 aa, Homo sapiens
  ENSP00000391379
MPKNKKRNTPHRGSSAGGGGSGAAAATAAT

SEQ ID NO: 29812 - protein, 451 aa, Homo sapiens
  ENSP00000005558
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 29813 - protein, 40 aa, Homo sapiens
  ENSP00000397592
MSHCSGYSDPSSFAEDGPEVLDEEGTQEDLEYKLKGLIDL

SEQ ID NO: 29814 - protein, 62 aa, Homo sapiens
  ENSP00000402453
MPKNKKRNTPHRGSSAGGGGSGAAAATAATAGGQHRNVQPFSDEDASIETMSHCSGYSDPSS

SEQ ID NO: 29815 - protein, 17 aa, Homo sapiens
  ENSP00000413893
MPKNKKRNTPHRGSSAG

SEQ ID NO: 29816 - protein, 451 aa, Homo sapiens; identical to SEQ ID NO: 29812
  ENSP00000384477

SEQ ID NO: 29817 - protein, 148 aa, Homo sapiens
  ENSP00000397314
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGNALIFESQTYN

SEQ ID NO: 29818 - protein, 103 aa, Homo sapiens
  ENSP00000437250
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLC

SEQ ID NO: 29819 - protein, 127 aa, Homo sapiens
  ENSP00000402177
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKII

SEQ ID NO: 29820 - protein, 90 aa, Homo sapiens
  ENSP00000403203
MHFHKLPSLLSCDDVNMRIAAGESLALLFELARGIESDFFYEDMESLTQMLRALATDGNKHRAKVDKRKQRSVFRDVLRAVEERDFPTET

SEQ ID NO: 29821 - protein, 98 aa, Homo sapiens
  ENSP00000435635
VFRDVLRAVEERDFPTETIKFGPERMYIDCWVKKHTYDTFKEVLGSGMQYHLQSNEFLRNVFELGPPVMLDAATLKTMKISRFERFSGLSGVFASQSS

SEQ ID NO: 29822 - protein, 401 aa, Homo sapiens
  ENSP00000483255
MSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 29823 - protein, 401 aa, Homo sapiens; identical to SEQ ID NO: 29822
  ENSP00000439188

SEQ ID NO: 29824 - protein, 30 aa, Homo sapiens; identical to SEQ ID NO: 29811
  ENSP00000391379

SEQ ID NO: 29825 - protein, 451 aa, Homo sapiens; identical to SEQ ID NO: 29812
  ENSP00000005558

SEQ ID NO: 29826 - protein, 40 aa, Homo sapiens; identical to SEQ ID NO: 29813
  ENSP00000397592

SEQ ID NO: 29827 - protein, 62 aa, Homo sapiens; identical to SEQ ID NO: 29814
  ENSP00000402453

SEQ ID NO: 29828 - protein, 17 aa, Homo sapiens
  ENSP00000413893
MPKNKKRNTPHRGSSAG

SEQ ID NO: 29829 - protein, 451 aa, Homo sapiens; identical to SEQ ID NO: 29812
  ENSP00000384477

SEQ ID NO: 29830 - protein, 148 aa, Homo sapiens; identical to SEQ ID NO: 29817
  ENSP00000397314

SEQ ID NO: 29831 - protein, 103 aa, Homo sapiens; identical to SEQ ID NO: 29818
  ENSP00000437250

SEQ ID NO: 29832 - protein, 127 aa, Homo sapiens; identical to SEQ ID NO: 29819
  ENSP00000402177

SEQ ID NO: 29833 - protein, 90 aa, Homo sapiens; identical to SEQ ID NO: 29820
  ENSP00000403203

SEQ ID NO: 29834 - protein, 98 aa, Homo sapiens; identical to SEQ ID NO: 29821
  ENSP00000435635

SEQ ID NO: 29835 - protein, 401 aa, Homo sapiens; identical to SEQ ID NO: 29822
  ENSP00000483255

SEQ ID NO: 29836 - protein, 401 aa, Homo sapiens; identical to SEQ ID NO: 29822
  ENSP00000439188

SEQ ID NO: 29837 - protein, 32 aa, Homo sapiens
  ENSP00000452051
MEDLLDLDEELRYSLATSSPECELPQNRSITG

SEQ ID NO: 29838 - protein, 213 aa, Homo sapiens
  ENSP00000238628
MEDLLDLDEELRYSLATSRAKMGRRAQQESAQAENHLNGKNSSLTLTGETSSAKLPRCRQGGWAGDSVKASNGTQTGKQQLDLNACYHKTHHRDLGLASLEEADIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 29839 - protein, 113 aa, Homo sapiens
  ENSP00000451096
MEDLLDLDEELRYSLATSRAKMGRRAQQESAQAENHLNGKNSSLTLTGETSSAKLPRCRQGGWAGDSVKASKFRRKASEEIEEYVSSILILMVSYVDLGQQCSLGGHDLFHLC

SEQ ID NO: 29840 - protein, 208 aa, Homo sapiens
  ENSP00000324177
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 29841 - protein, 208 aa, Homo sapiens; identical to SEQ ID NO: 29840
  ENSP00000440064

SEQ ID NO: 29842 - protein, 814 aa, Homo sapiens
  ENSP00000332773
MAVQRAASPRRPPAPLWPRLLLPLLLLLLPAPSEGLGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 29843 - protein, 535 aa, Homo sapiens
  ENSP00000454105
MSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKD

SEQ ID NO: 29844 - protein, 137 aa, Homo sapiens
  ENSP00000452838
MPDSLIHPRWCERAMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECV

SEQ ID NO: 29845 - protein, 1250 aa, Homo sapiens
  ENSP00000319623
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 29846 - protein, 180 aa, Homo sapiens
  ENSP00000414497
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 29847 - protein, 236 aa, Homo sapiens
  ENSP00000391826
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 29848 - protein, 183 aa, Homo sapiens
  ENSP00000370799
MGIPMGKSMLVLLTFLAFASCCIAAYRPSETLCGGELVDTLQFVCGDRGFYFRLPGRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 29849 - protein, 180 aa, Homo sapiens; identical to SEQ ID NO: 29846
  ENSP00000370796

SEQ ID NO: 29850 - protein, 180 aa, Homo sapiens; identical to SEQ ID NO: 29846
  ENSP00000402047

SEQ ID NO: 29851 - protein, 180 aa, Homo sapiens; identical to SEQ ID NO: 29846
  ENSP00000370802

SEQ ID NO: 29852 - protein, 183 aa, Homo sapiens; identical to SEQ ID NO: 29848
  ENSP00000370813

SEQ ID NO: 29853 - protein, 194 aa, Homo sapiens
  ENSP00000370476
MQRARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29854 - protein, 291 aa, Homo sapiens
  ENSP00000275521
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29855 - protein, 297 aa, Homo sapiens
  ENSP00000370473
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29856 - protein, 143 aa, Homo sapiens
  ENSP00000390298
  MOD_RES (1)..(1): Any amino acid
XESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29857 - protein, 153 aa, Homo sapiens
  ENSP00000399116
  MOD_RES (1)..(1): Any amino acid
XSEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29858 - protein, 132 aa, Homo sapiens
  ENSP00000389668
MRSAVCQFPRHRLAAGRPHPESGRGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDK

SEQ ID NO: 29859 - protein, 270 aa, Homo sapiens
  ENSP00000477772
MQRARPTLWAAALTLLVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29860 - protein, 263 aa, Homo sapiens
  ENSP00000480717
MQRARPTLWAACEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 29861 - protein, 272 aa, Homo sapiens
  ENSP00000233813
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 29862 - protein, 233 aa, Homo sapiens
  ENSP00000413474
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIGCAPGGQRHICFSLYYSPHPKLPSPGLWPCAPWPTGADPPAPSPAERDSREHEEPTTSEMAEETYSPKIFRPKHTRISELKAEAVKKDRRKKLTQSKFVGGAENTAHPRIISAPEMRQESE

SEQ ID NO: 29863 - protein, 430 aa, Homo sapiens
  ENSP00000406092
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 29864 - protein, 431 aa, Homo sapiens
  ENSP00000377370
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 29865 - protein, 407 aa, Homo sapiens
  ENSP00000420486
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 29866 - protein, 406 aa, Homo sapiens
  ENSP00000401240
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 29867 - protein, 403 aa, Homo sapiens
  ENSP00000417413
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISRAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 29868 - protein, 59 aa, Homo sapiens
  ENSP00000418976
MVTPLSNANQPEQVILYQGGQMFDGAPRFHGRVGFTGTMPATNVSIFINNTQLSDTGTY

SEQ ID NO: 29869 - protein, 32 aa, Homo sapiens
  ENSP00000418047
MVTPLSNANQPEQVILYQGGQMFDGAPRFHGR

SEQ ID NO: 29870 - protein, 430 aa, Homo sapiens; identical to SEQ ID NO: 29863
  ENSP00000346700

SEQ ID NO: 29871 - protein, 1194 aa, Homo sapiens
  ENSP00000358498
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 29872 - protein, 1214 aa, Homo sapiens
  ENSP00000321184
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 29873 - protein, 5 aa, Homo sapiens
  ENSP00000474657
MDSSF

SEQ ID NO: 29874 - protein, 1214 aa, Homo sapiens; identical to SEQ ID NO: 29872
  ENSP00000358495

SEQ ID NO: 29875 - protein, 346 aa, Homo sapiens
  ENSP00000433514
  MOD_RES (1)..(1): Any amino acid
XPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPTWGEGVLLCCPSWS

SEQ ID NO: 29876 - protein, 1332 aa, Homo sapiens
  ENSP00000363779
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVWLEDLQREESSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 29877 - protein, 983 aa, Homo sapiens
  ENSP00000439367
MWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNLIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEECAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 29878 - protein, 162 aa, Homo sapiens
  ENSP00000323505
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 29879 - protein, 162 aa, Homo sapiens; identical to SEQ ID NO: 29878
  ENSP00000296545

SEQ ID NO: 29880 - protein, 135 aa, Homo sapiens
  ENSP00000422271
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 29881 - protein, 162 aa, Homo sapiens; identical to SEQ ID NO: 29878
  ENSP00000435462

SEQ ID NO: 29882 - protein, 135 aa, Homo sapiens; identical to SEQ ID NO: 29880
  ENSP00000436914

SEQ ID NO: 29883 - protein, 135 aa, Homo sapiens; identical to SEQ ID NO: 29880
  ENSP00000377714

SEQ ID NO: 29884 - protein, 454 aa, Homo sapiens
  ENSP00000452738
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQKEEMEAQEVK

SEQ ID NO: 29885 - protein, 484 aa, Homo sapiens
  ENSP00000456972
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEDAEMELGPPGS

SEQ ID NO: 29886 - protein, 594 aa, Homo sapiens
  ENSP00000453250
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMS

SEQ ID NO: 29887 - protein, 1331 aa, Homo sapiens
  ENSP00000378155
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 29888 - protein, 1332 aa, Homo sapiens
  ENSP00000302935
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 29889 - protein, 201 aa, Homo sapiens
  ENSP00000454636
  MOD_RES (1)..(1): Any amino acid
XQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEDAEMELGPPGS

SEQ ID NO: 29890 - protein, 631 aa, Homo sapiens
  ENSP00000378147
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 29891 - protein, 44 aa, Homo sapiens
  ENSP00000453131
SASAGCPGPGIGPQTKSSTEGEPGWRRASPAWKLEFRKKSHCMM

SEQ ID NO: 29892 - protein, 611 aa, Homo sapiens
  ENSP00000453214
  MOD_RES (1)..(1): Any amino acid
XRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGVGCVWFFACSPVVGMWPGPQKASGHFLGYVVSHNSMSSS

SEQ ID NO: 29893 - protein, 193 aa, Homo sapiens
  ENSP00000280357
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 29894 - protein, 189 aa, Homo sapiens
  ENSP00000434561
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 29895 - protein, 193 aa, Homo sapiens; identical to SEQ ID NO: 29893
  ENSP00000434161

SEQ ID NO: 29896 - protein, 311 aa, Homo sapiens
  ENSP00000328133
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 29897 - protein, 49 aa, Homo sapiens
  ENSP00000418637
MQTFTMVLEEIWTSLFMWFFYALIPCLLTGWSAVVQSQLTATSASEALH

SEQ ID NO: 29898 - protein, 55 aa, Homo sapiens
  ENSP00000417437
MAGAPSPASLPPCSLISDCCASNQRDSVGVGPSEPGWSAVVQSQLTATSASEALH

SEQ ID NO: 29899 - protein, 120 aa, Homo sapiens
  ENSP00000420725
AILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSRTAFLLSVHLCPELVGS

SEQ ID NO: 29900 - protein, 179 aa, Homo sapiens
  ENSP00000442424
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 29901 - protein, 179 aa, Homo sapiens; identical to SEQ ID NO: 29900
  ENSP00000329384

SEQ ID NO: 29902 - protein, 179 aa, Homo sapiens; identical to SEQ ID NO: 29900
  ENSP00000442424

SEQ ID NO: 29903 - protein, 179 aa, Homo sapiens; identical to SEQ ID NO: 29900
  ENSP00000329384

SEQ ID NO: 29904 - protein, 270 aa, Homo sapiens
  ENSP00000370842
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 29905 - protein, 144 aa, Homo sapiens
  ENSP00000394039
MKPKMKYSTNKISTAKWKNTASKALCFKLGNKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 29906 - protein, 228 aa, Homo sapiens
  ENSP00000478858
MKPKMKYSTNKISTAKWKNTASKALCFKLGKSQQKAKEVCPMYFMKLRSGLMIKKEACYFRRETTKRPSLKTGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 29907 - protein, 228 aa, Homo sapiens
  ENSP00000414238
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 29908 - protein, 639 aa, Homo sapiens
  ENSP00000271417
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 29909 - protein, 580 aa, Homo sapiens
  ENSP00000432750
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQAFRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 29910 - protein, 512 aa, Homo sapiens
  ENSP00000436120
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 29911 - protein, 167 aa, Homo sapiens
  ENSP00000431316
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLE

SEQ ID NO: 29912 - protein, 437 aa, Homo sapiens
  ENSP00000437008
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHRMTFQPGCPLWSDVVNISLDNEKSDMDYGDKTQI

SEQ ID NO: 29913 - protein, 620 aa, Homo sapiens
  ENSP00000436882
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 29914 - protein, 531 aa, Homo sapiens
  ENSP00000434273
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 29915 - protein, 99 aa, Homo sapiens
  ENSP00000465416
MERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 29916 - protein, 288 aa, Homo sapiens
  ENSP00000269159
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQELEFGVIYHCTEERLYTGRRGRGAFCNGQRLRVSGETDLSKALVLTEIGPKRDPATLKLFLSNMERLLHAKAHGVRVIGSSTLALCHLASGAADAYYQFGLHCWDLAAATVIIREAGGIVIDTSGGPLDLMACRVVAASTREMAMLIAQALQTINYGRDDEK

SEQ ID NO: 29917 - protein, 163 aa, Homo sapiens
  ENSP00000466059
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHRFPTVAVSIGFAVRQEVRVWPRSPGPLPGLPLAILPFWLQPLCAWFAVCPVP

SEQ ID NO: 29918 - protein, 85 aa, Homo sapiens
  ENSP00000372867
MKPSGEDQAALAAGPWEECFQAAVQLALRAGQIIRKALTEEKRVSTKTSAADLVTETDHLVEDLIISELRERFPSHRSPFSLVHM

SEQ ID NO: 29919 - protein, 116 aa, Homo sapiens
  ENSP00000465938
MKPSGEDQAALAAGPWEECFQAAVQLALRAGQIIRKALTEEKRVSTKTSAADLVTETDHLVEDLIISELRERFPSHRFIAEEAAASGAKCVLTHSPTWIIDPIDGTCNFVHSLNSE

SEQ ID NO: 29920 - protein, 99 aa, Homo sapiens; identical to SEQ ID NO: 29915
  ENSP00000464767

SEQ ID NO: 29921 - protein, 126 aa, Homo sapiens
  ENSP00000464754
  MOD_RES (1)..(1): Any amino acid
XHSPTWIIDPIDGTCNFVHRFPTVAVSIGFAVRQELEFGVIYHCTEERLYTGRRGRGAFCNGQRLRVSGETEMGLRHAAQAGLEVLTSKRSAHLSLAKCWDYRHEPPRPAHESLKGLGSDRNWPQT

SEQ ID NO: 29922 - protein, 85 aa, Homo sapiens; identical to SEQ ID NO: 29918
  ENSP00000486461

SEQ ID NO: 29923 - protein, 797 aa, Homo sapiens
  ENSP00000358966
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 29924 - protein, 158 aa, Homo sapiens
  ENSP00000358968
ERPNGTSAQPAQVKPEFYRQAELKPCPWTGSNQRRCITFCPTPDQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 29925 - protein, 719 aa, Homo sapiens
  ENSP00000481913
MYLETRRAIFVFWIFLQVQGTKVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 29926 - protein, 140 aa, Homo sapiens
  ENSP00000358980
MKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTEKNKGKTKPFNILQFGNNHHEHLLPIFCLLSSIIYTYY

SEQ ID NO: 29927 - protein, 40 aa, Homo sapiens
  ENSP00000431682
MESKDEVSDTDSGIILQSGPDSPVSPMKELTHAVHKQQRA

SEQ ID NO: 29928 - protein, 123 aa, Homo sapiens
  ENSP00000397255
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLC

SEQ ID NO: 29929 - protein, 663 aa, Homo sapiens
  ENSP00000356311
MLQMPKLNEIPPGRAGRREARGEGRWPGQTGPEAARLEWRAQGQAGGARAPWDSWGSSRLPTQPGPGWSRCPPSLLCALSFQKSTMESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 29930 - protein, 578 aa, Homo sapiens
  ENSP00000392105
MESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELRRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLRRSPDGAPVQVFVPEKGEIISQV

SEQ ID NO: 29931 - protein, 40 aa, Homo sapiens; identical to SEQ ID NO: 29927
  ENSP00000431682

SEQ ID NO: 29932 - protein, 123 aa, Homo sapiens; identical to SEQ ID NO: 29928
  ENSP00000397255

SEQ ID NO: 29933 - protein, 663 aa, Homo sapiens; identical to SEQ ID NO: 29929
  ENSP00000356311

SEQ ID NO: 29934 - protein, 578 aa, Homo sapiens; identical to SEQ ID NO: 29930
  ENSP00000392105

SEQ ID NO: 29935 - protein, 1240 aa, Homo sapiens
  ENSP00000376406
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEGLRPRPKAK

SEQ ID NO: 29936 - protein, 234 aa, Homo sapiens
  ENSP00000381380
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLR

SEQ ID NO: 29937 - protein, 1249 aa, Homo sapiens
  ENSP00000376410
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAEDEEELLRVSGGVDMSSHQEVFASLFHKVSCSPVSAQLLSVLQGLLHLEPTLRSSQLLWEALESLVNRAVLLASDAQECTLEEVVERLLSVKGRPRPSPLVKAHKSVQANLDQSQRGSSPQNTTTPKPSVEGQQPAAAAACEPVDHAQSESILKVSQPRALEQQASTPPPPPPPPLLPGSSAEPPPPPPPPPLPSVGAKALPTAPPPPPLPGLGAMAPPAPPLPPPLPGSCEFLPPPPPPLPGLGCPPPPPPLLPGMGWGPPPPPPPLLPCTCSPPVAGGMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 29938 - protein, 717 aa, Homo sapiens
  ENSP00000252527
GMEEVIVAQVDHGLGSAWVPSHRRVNPPTLRMKKLNWQKLPSNVAREHNSMWASLSSPDAEAVEPDFSSIERLFSFPAAKPKEPTMVAPRARKEPKEITFLDAKKSLNLNIFLKQFKCSNEEVAAMIRAGDTTKFDVEVLKQLLKLLPEKHEIENLRAFTEERAKLASADHFYLLLLAIPCYQLRIECMLLCEGAAAVLDMVRPKAQLVLAACESLLTSRQLPIFCQLILRIGNFLNYGSHTGDADGFKISTLLKLTETKSQQNRVTLLHHVLEEAEKSHPDLLQLPRDLEQPSQAAGINLEIIRSEASSNLKKLLETERKVSASVAEVQEQYTERLQASISAFRALDELFEAIEQKQRELADYLCEDAQQLSLEDTFSTMKAFRDLFLRALKENKDRKEQAAKAERRKQQLAEEEARRPRGEDGKPVRKGPGKQEEVCVIDALLADIRKGFQLRKTARGRGDTDGGSKAASMDPPRATEPVATSNPAGDPVGSTRCPASEPGLDATTASESRGWDLVDAVTPGPQPTLEQLEEGGPRPLERRSSWYVDASDVLTTEDPQCPQPLEGAWPVTLGDAQALKPLKFSSNQPPAAGSSRQDAKDPTSLLGVLQAEADSTSEGLEDAVHSRGARPPAAGPGGDEDEDEEDTAPESALDTSLDKSFSEDAVTDSSGSGTLPRARGRASKGTGKRRKKRPSRSQEEVPPDSDDNKTKKLCVIQ

SEQ ID NO: 29939 - protein, 142 aa, Homo sapiens
  ENSP00000483829
MQCFASLYCLEVAELGALGRGKLAGSAMAGQGPLPWGLAPVPACPAPEVGVGGGLPLLPLPGLCPAAETWPSHQQKTPPSASCPAWAGPGDNTGPPEGLQGDTQQPLPPHCPPSEGSLPEPAPCQVCALRLAAGCVANKKQT

SEQ ID NO: 29940 - protein, 426 aa, Homo sapiens
  ENSP00000242208
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 29941 - protein, 426 aa, Homo sapiens; identical to SEQ ID NO: 29940
  ENSP00000397197

SEQ ID NO: 29942 - protein, 426 aa, Homo sapiens; identical to SEQ ID NO: 29940
  ENSP00000490646

SEQ ID NO: 29943 - protein, 399 aa, Homo sapiens
  ENSP00000325423
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTLRWKGQCYWGLSYMGTNMHSLQLTISRRNGSETHTGNTGSEAAFSPSFSAVISTSEKETIKAALSRVCGDRIFGAAGAGYKSLCVVQGLVDIYIFSEDTTFKWDSCAAHAILRAMGGGIVDLKECLERNPETGLDLPQLVYHVENEGAAGVDRWANKGGLIAYRSRKRLETFLSLLVQNLAPAETHT

SEQ ID NO: 29944 - protein, 9 aa, Homo sapiens
  ENSP00000415014
MSDILRELL

SEQ ID NO: 29945 - protein, 88 aa, Homo sapiens
  ENSP00000391415
MSDILRELLCVSEKAANIARACRQQEALFQLLIEEKKEGEKNKKFAVDFKTLADVLVQEVIKQNMENKFPGLEKNIFGEESNEFTNDW

SEQ ID NO: 29946 - protein, 213 aa, Homo sapiens
  ENSP00000409786
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNTL

SEQ ID NO: 29947 - protein, 190 aa, Homo sapiens
  ENSP00000404732
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYD

SEQ ID NO: 29948 - protein, 143 aa, Homo sapiens
  ENSP00000392814
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINV

SEQ ID NO: 29949 - protein, 212 aa, Homo sapiens
  ENSP00000395424
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPIDSTYQYIKGSADIKSNQGIFPCGLQCVTILIGVYDIQTGVPLMGVINQPFVSRDPNT

SEQ ID NO: 29950 - protein, 30 aa, Homo sapiens
  ENSP00000410662
MSDILRELLCVSEKAANIARACRQQEALFQ

SEQ ID NO: 29951 - protein, 155 aa, Homo sapiens
  ENSP00000387079
MSDILRELLCVSEKAANIARACRQQEALFQLLIEEKKEGEKNKKFAVDFKTLADVLVQEVIKQNMENKFPGLEKNIFGEESNEFTNDWGEKITLRLCSTEEETAELLSKVLNGNKVASEALARVVHQDVAFTDPTLDSTEINVPQDILGIWVDPI

SEQ ID NO: 29952 - protein, 68 aa, Homo sapiens
  ENSP00000412119
MSDILRELLCVSEKAANIARACRQQEALFQLLIEEKKEGEKNKKFAVDFKTLADVLVQEVIKQNMENK

SEQ ID NO: 29953 - protein, 399 aa, Homo sapiens; identical to SEQ ID NO: 29943
  ENSP00000376142

SEQ ID NO: 29954 - protein, 924 aa, Homo sapiens
  ENSP00000425487
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 29955 - protein, 924 aa, Homo sapiens; identical to SEQ ID NO: 29954
  ENSP00000423954

SEQ ID NO: 29956 - protein, 938 aa, Homo sapiens
  ENSP00000422793
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRSRQTQGALNESDDPETGCLTDNKPTSRHFYPVALLLVSSHLLVVWLILSLALLLAKYQ

SEQ ID NO: 29957 - protein, 688 aa, Homo sapiens
  ENSP00000426207
MGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFI

SEQ ID NO: 29958 - protein, 416 aa, Homo sapiens
  ENSP00000423771
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQMLSTMSSLWEPQLPIFRDLRMVVFGSYSIDLKQKEEIPDTSLFTIHLKTQPKQRKFSATSINYNLL

SEQ ID NO: 29959 - protein, 817 aa, Homo sapiens
  ENSP00000427250
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKK

SEQ ID NO: 29960 - protein, 686 aa, Homo sapiens
  ENSP00000421065
MIHFHPLILPHERSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQS

SEQ ID NO: 29961 - protein, 33 aa, Homo sapiens
  ENSP00000424731
EYPIYEETKIKLTVYDVKDKSHDTFRINRLTSL

SEQ ID NO: 29962 - protein, 65 aa, Homo sapiens
  ENSP00000425764
  MOD_RES (1)..(1): Any amino acid
XIHPVEQSLTRYSSTEIVEGTRDPLFLTGVTFPSEYPIYEETKIKLTVYDVKDKSHDTIANSSRI

SEQ ID NO: 29963 - protein, 131 aa, Homo sapiens
  ENSP00000424057
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTIANSSRI

SEQ ID NO: 29964 - protein, 84 aa, Homo sapiens
  ENSP00000426957
MEIKEEGASEEGQHFLPTAQANDPGDCQFTSIQKTPNEPQLEFILACKDLVAPVRDRKLNTLVQISVIHPVEQSLTRYSSTEIV

SEQ ID NO: 29965 - protein, 47 aa, Homo sapiens
  ENSP00000420888
MEIKEEGASEEGQHFLPTAQANDPGDCQFTSIQKTPNEPQLEFILGN

SEQ ID NO: 29966 - protein, 53 aa, Homo sapiens
  ENSP00000426897
MEIKEEGASEEGQHFLPTAQANDPGDCQFTSIQKTPNEPQLEFILDLNQELRD

SEQ ID NO: 29967 - protein, 39 aa, Homo sapiens
  ENSP00000422052
MEIKEEGASEEGQHFLPTAQANDPGDCQFTSIQKTPNEP

SEQ ID NO: 29968 - protein, 924 aa, Homo sapiens; identical to SEQ ID NO: 29954
  ENSP00000262992

SEQ ID NO: 29969 - protein, 53 aa, Homo sapiens; identical to SEQ ID NO: 29966
  ENSP00000486368

SEQ ID NO: 29970 - protein, 412 aa, Homo sapiens
  ENSP00000357583
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 29971 - protein, 387 aa, Homo sapiens
  ENSP00000357582
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRVSVCCPSPGHRGMWSAGSGLAQPW

SEQ ID NO: 29972 - protein, 138 aa, Homo sapiens
  ENSP00000390936
VTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLD

SEQ ID NO: 29973 - protein, 278 aa, Homo sapiens
  ENSP00000340707
  MOD_RES (1)..(1): Any amino acid
XQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVELLEFDKELSVFKDRLYELDISFPPSYPYSEDARQGEQYMNTRCPAWCDRILMSPSAKELVLR

SEQ ID NO: 29974 - protein, 104 aa, Homo sapiens
  ENSP00000390749
LDISFPPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 29975 - protein, 1188 aa, Homo sapiens
  ENSP00000486669
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 29976 - protein, 1189 aa, Homo sapiens
  ENSP00000487191
MVPCWNHGNITRSKAEELLSRTGKDGSFLVRASESISRAYALCVLYRNCVYTYRILPNEDDKFTVQASEGVSMRFFTKLDQLIEFYKKENMGLVTHLQYPVPLEEEDTGDDPEEDTVESVVSPPELPPRNIPLTASSCEAKEVPFSNENPRATETSRPSLSETLFQRLQSMDTSGLPEEHLKAIQDYLSTQLAQDSEFVKTGSSSLPHLKKLTTLLCKELYGEVIRTLPSLESLQRLFDQQLSPGLRPRPQVPGEANPINMVSKLSQLTSLLSSIEDKVKALLHEGPESPHRPSLIPPVTFEVKAESLGIPQKMQLKVDVESGKLIIKKSKDGSEDKFYSHKKILQLIKSQKFLNKLVILVETEKEKILRKEYVFADSKKREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 29977 - protein, 810 aa, Homo sapiens
  ENSP00000487535
KREGFCQLLQQMKNKHSEQPEPDMITIFIGTWNMGNAPPPKKITSWFLSKGQGKTRDDSADYIPHDIYVIGTQEDPLSEKEWLEILKHSLQEITSVTFKTVAIHTLWNIRIVVLAKPEHENRISHICTDNVKTGIANTLGNKGAVGVSFMFNGTSLGFVNSHLTSGSEKKLRRNQNYMNILRFLALGDKKLSPFNITHRFTHLFWFGDLNYRVDLPTWEAETIIQKIKQQQYADLLSHDQLLTERREQKVFLHFEEEEITFAPTYRFERLTRDKYAYTKQKATGMKYNLPSWCDRVLWKSYPLVHVVCQSYGSTSDIMTSDHSPVFATFEAGVTSQFVSKNGPGTVDSQGQIEFLRCYATLKTKSQTKFYLEFHSSCLESFVKSQEGENEEGSEGELVVKFGETLPKLKPIISDPEYLLDQHILISIKSSDSDESYGEGCIALRLEATETQLPIYTPLTHHGELTGHFQGEIKLQTSQGKTREKLYDFVKTERDESSGPKTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESRPSDLGKNAGDTLPQEDLPLTKPEMFENPLYGSLSSFPKPAPRKDQESPKMPRKEPPPCPEPGILSPSIVLTKAQEADRGEGPGKQVPAPRLRSFTCSSSAEGRAAGGDKSQGKPKTPVSSQAPVPAKRPIKPSRSEINQQTPPTPTPRPPLPVKSPAVLHLQHSKGRDYRDNTELPHHGKHRPEEGPPGPLGRTAMQ

SEQ ID NO: 29978 - protein, 130 aa, Homo sapiens
  ENSP00000487335
KTLKSLTSHDPMKQWEVTSRAPPCSGSSITEIINPNYMGVGPFGPPMPLHVKQTLSPDQQPTAWSYDQPPKDSPLGPCRGESPPTPPGQPPISPKKFLPSTANRGLPPRTQESSEALSELPLSREPRGTA

SEQ ID NO: 29979 - protein, 43 aa, Homo sapiens
  ENSP00000486018
  MOD_RES (1)..(1): Any amino acid
XTELPHHGKHRPEEGPPGPLGRTAMQVRCATRGFVCICVCVHA

SEQ ID NO: 29980 - protein, 1188 aa, Homo sapiens; identical to SEQ ID NO: 29975
  ENSP00000352575

SEQ ID NO: 29981 - protein, 1189 aa, Homo sapiens; identical to SEQ ID NO: 29976
  ENSP00000405338

SEQ ID NO: 29982 - protein, 810 aa, Homo sapiens; identical to SEQ ID NO: 29977
  ENSP00000397421

SEQ ID NO: 29983 - protein, 130 aa, Homo sapiens; identical to SEQ ID NO: 29978
  ENSP00000414835

SEQ ID NO: 29984 - protein, 43 aa, Homo sapiens; identical to SEQ ID NO: 29979
  ENSP00000473280
  MOD_RES (1)..(1): Any amino acid

SEQ ID NO: 29985 - protein, 579 aa, Homo sapiens
  ENSP00000368872
MRRPPGNGEAASEGPGGWGLWGVQESRRLCCAGHDRCKQALLQIGINMMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 29986 - protein, 532 aa, Homo sapiens
  ENSP00000368874
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 29987 - protein, 520 aa, Homo sapiens
  ENSP00000435022
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAMGIQLQVKKTNISALLLWFLFWHIQGCSA

SEQ ID NO: 29988 - protein, 532 aa, Homo sapiens; identical to SEQ ID NO: 29986
  ENSP00000436194

SEQ ID NO: 29989 - protein, 490 aa, Homo sapiens
  ENSP00000436113
MMALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQALVRKIDASDNIYTTESTTGNLFSLTQEGAPLCRIIAKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 29990 - protein, 566 aa, Homo sapiens
  ENSP00000389161
MALPGGRHLDSVTLPGQRLHLMQVDSVQRWMEDLKLMTECECMCVLQAKPISLEEDAQGDLILAGGPGPGDPLQLLLKRGWVISTELRRIGQKLAQDRWARVHSMSVRLTCHARSMVSEYSAVSRNSLKEMGEIEKLLMEKCSELSAVTERCLQVENEHVLKSMKACVSETLSMLGQHFGQLLELALTREVQVESHSVTRLECSGAISAQCNLRLLGSSDSPASASQALVRKIDASDNIYTTESTTGNLFSLTQEGAPLCRIIAKEGGVVALFKVCRQDSFRCLYPQALRTLASICCVEEGVHQLEKVDGVLCLADILTDNSHSEATRAEAAAVVAQVTSPHLPVTQHLSSFLESMEEIVTALVKLCQEASSGEVFLLASAALANITFFDTMACEMLLQLNAIRVLLEACSDKQRVDTPYTRDQIVTILANMSVLEQCASDIIQENGVQLIMGMLSEKPRSGTPAEVAACERVQQKAAVTLARLSRDPDVAREAVRLSCMSRLIELCRSPSERNSSDAVLVACLAALRRLAGVCPEGLQDSDFQQLVQPRLVDSFLLCSNMEESFV

SEQ ID NO: 29991 - protein, 277 aa, Homo sapiens
  ENSP00000344741
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 29992 - protein, 123 aa, Homo sapiens
  ENSP00000414691
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIF

SEQ ID NO: 29993 - protein, 164 aa, Homo sapiens
  ENSP00000344035
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGIHPQISSIFVLGSLVYFSQEASRWGT

SEQ ID NO: 29994 - protein, 239 aa, Homo sapiens
  ENSP00000420198
  MOD_RES (1)..(1): Any amino acid
XSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 29995 - protein, 178 aa, Homo sapiens
  ENSP00000340010
MPRLHDHFWSCSCAHSARRRGPPRASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 29996 - protein, 437 aa, Homo sapiens
  ENSP00000265198
MTSYMAIDGSALVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 29997 - protein, 438 aa, Homo sapiens
  ENSP00000394751
MTSYMAIDGSALQVPLRQKPRRKTQGFLTMSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 29998 - protein, 438 aa, Homo sapiens; identical to SEQ ID NO: 29997
  ENSP00000356189

SEQ ID NO: 29999 - protein, 409 aa, Homo sapiens
  ENSP00000430287
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 30000 - protein, 157 aa, Homo sapiens
  ENSP00000431092
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESEQEDPEIAAETPPPPHASQTQSLTAQQASS

SEQ ID NO: 30001 - protein, 128 aa, Homo sapiens
  ENSP00000428767
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLGSAVIHQESTTKDEECYSESE

SEQ ID NO: 30002 - protein, 108 aa, Homo sapiens
  ENSP00000429972
MSRRRISCKDLGHADCQGWLYKKKEKGSFLSNKWKKFWVILKGSSLYWYSNQMAEKADGFVNLPDFTVERASECKKKHAFKISHPQIKTFYFAAENVQEMNVWLNKLG

SEQ ID NO: 30003 - protein, 78 aa, Homo sapiens
  ENSP00000431004
MTSYMAIDGSALVPLRQKPRRKTQGFLTMSRRRISCKDLGHADCQGWLYKKKEKGSFLSNKWKKFWVILKGSSLYWYS

SEQ ID NO: 30004 - protein, 2710 aa, Homo sapiens
  ENSP00000349597
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 30005 - protein, 2695 aa, Homo sapiens
  ENSP00000397885
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 30006 - protein, 2743 aa, Homo sapiens
  ENSP00000401671
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 30007 - protein, 2743 aa, Homo sapiens; identical to SEQ ID NO: 30006
  ENSP00000306253

SEQ ID NO: 30008 - protein, 2758 aa, Homo sapiens
  ENSP00000346595
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 30009 - protein, 721 aa, Homo sapiens
  ENSP00000440564
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 30010 - protein, 2710 aa, Homo sapiens; identical to SEQ ID NO: 30004
  ENSP00000349597

SEQ ID NO: 30011 - protein, 2695 aa, Homo sapiens; identical to SEQ ID NO: 30005
  ENSP00000397885

SEQ ID NO: 30012 - protein, 2743 aa, Homo sapiens; identical to SEQ ID NO: 30006
  ENSP00000401671

SEQ ID NO: 30013 - protein, 2743 aa, Homo sapiens; identical to SEQ ID NO: 30006
  ENSP00000306253

SEQ ID NO: 30014 - protein, 2758 aa, Homo sapiens; identical to SEQ ID NO: 30008
  ENSP00000346595

SEQ ID NO: 30015 - protein, 721 aa, Homo sapiens; identical to SEQ ID NO: 30009
  ENSP00000440564

SEQ ID NO: 30016 - protein, 168 aa, Homo sapiens
  ENSP00000427323
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKAC

SEQ ID NO: 30017 - protein, 60 aa, Homo sapiens
  ENSP00000421223
MAQNTENHDPVGSILIQIHEDLYQLKEKLTKFSPEEKGETLDIQSLETAIKRTEVGLRGF

SEQ ID NO: 30018 - protein, 1027 aa, Homo sapiens
  ENSP00000336861
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKIKVSKLIKGSNISSLTVLPSSHCTDPYFTPIPVLQADAHKGILSMIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPKHHMCLATHLMYSPKAIKRIKNLIRGTEAYIVSGLLHRDDLAVADMLDIPILGSEPELAHLYSTKSGGKRVFDSANVAVPPGIYDIYSQQQMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 30019 - protein, 170 aa, Homo sapiens
  ENSP00000441306
MAQNTENHDPVGSILIQIHEDLYQLKEKLTKFSPEEKGETLDIQSLETAIKRTEVGLRIHIEKYLNVVNQNVLTTSVNDESLYTPQASKWLLPTVIDQKSFIFPQESEGTFWQPQRQHSSSLPVFPRAKRKIGLNVKILQDPENIHHRAAVNANYGISLPYINQRKACGF

SEQ ID NO: 30020 - protein, 19 aa, Homo sapiens
  ENSP00000453749
MAQNTENHDPVGSILIQGF

SEQ ID NO: 30021 - protein, 46 aa, Homo sapiens
  ENSP00000454387
KLTKFSPEEKGETLDIQSLETAIKRTEVGLRPLSLYLGNHLHLQQK

SEQ ID NO: 30022 - protein, 194 aa, Homo sapiens
  ENSP00000457425
  MOD_RES (1)..(1): Any amino acid
XFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIP

SEQ ID NO: 30023 - protein, 90 aa, Homo sapiens
  ENSP00000456293
TVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 30024 - protein, 684 aa, Homo sapiens
  ENSP00000444118
MKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVEERQGTVFILYEHLKRHKLGMLTIGEDLQGVLMTFARHLFIIHQEISAPNMQGETNFKTTIADIETILRVTKENKMRFEEEQQSKDDKNLSKPKK

SEQ ID NO: 30025 - protein, 621 aa, Homo sapiens
  ENSP00000351617
MTKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGYSQPVREHIADFNTQQNMQLGRLCDILDANVNVIYICSHHMNDELVLYYKKILSLHAAVKSGNLEDRSDLQDRFKIITPEAVNIFPMIEQLSQLITDHLQIQRWLFKMDSEFRGNGTAFCDIPSYLKCYKWVLKESSRYGLEDWRKKWAQEPALVKISEELAGILAQHAQPVNEKRFPTWRKFLQTFLSQGGVIEAFPPADNVTNLTVDMLIEPNGKISVLSTGDQLHAESPFISSGTTVPQTSVDPQVLTYLCLQIGKACRMRDVVGYFSIDLVTFIDPSTLEQQVWATGLNLAYSDQLALTQLTLYLTNGHLDCSLSTLEVPRFVPKERKKTKCMSALSMPMLATSRYAVMTTQLRHSNLSLVFHYVFLQICRAHGIGYDVENNRRGSPGGPHDLCSPSLHHPSRNIST

SEQ ID NO: 30026 - protein, 305 aa, Homo sapiens
  ENSP00000486970
MIERGLIPPTARITFQNPPITPRAAPLHSFDEARKIPTVATFTIPREPPPSPAEVKFFPKKQRSKGKSRRSRGHHDRKAMKVKTPLRALKSLWDYDFLIYDGVIDNTAPDFLAFKEHFSLAWGGIFSLLEHVEKFLRNYAIPEVKIKGNNLVALLPEFELTNKLTRYDLLSVLEDPAHVQMLINLPGQRYKGQDGNSEAAMKIQATWKCYKARKFFLFYRQQKWASGVIAIAWLLYCHKTRLKKILKESRQRHLENFRIRAKHLAANWNRIRTSRRTIIHIPSLGITLLPANLSATSITHHIMAP

SEQ ID NO: 30027 - protein, 1657 aa, Homo sapiens
  ENSP00000268182
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 30028 - protein, 1191 aa, Homo sapiens
  ENSP00000488618
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKFCAFLQ

SEQ ID NO: 30029 - protein, 1085 aa, Homo sapiens
  ENSP00000453181
MSAADEVDGLGVARPHYGSVLDNERLTAEEMDERRRGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 30030 - protein, 43 aa, Homo sapiens
  ENSP00000452723
MPRCIYCIHALSLYLFKLGLAPQIQDLYGKVDFTEEEINNMKT

SEQ ID NO: 30031 - protein, 48 aa, Homo sapiens
  ENSP00000484647
  MOD_RES (1)..(1): Any amino acid
XEVDGLGVARPHYGSVLDNERLTAEEMDERRRQNVAYEYLCHLEEAKR

SEQ ID NO: 30032 - protein, 107 aa, Homo sapiens
  ENSP00000480393
VKGGYYYYHNLETQEGGWDEPPNFVQNSMQLSREEIQSSISGVTAAYNREQLWLANEGLITRLQARCRGYLVRQEFRSRMNFLKKQIPAITCIQVFQNLSHRQQAGI

SEQ ID NO: 30033 - protein, 963 aa, Homo sapiens
  ENSP00000273221
MWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 30034 - protein, 814 aa, Homo sapiens
  ENSP00000478001
MLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGVHH

SEQ ID NO: 30035 - protein, 1114 aa, Homo sapiens
  ENSP00000480301
MACRRRYFVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEGSIISSPHMRRRATSTRECPSRPHQTMPNSSSLLGSLFGSKRGKPPPQAHLPSAPALPPPHPPVVLPHLQHSVAGHHLGPPEGLPQAAMHGHHTQYCHMQNPPPYHHHHHHHPPQHIQHAHQYHHGPHGGHPAYGAHAHGHPPLPSAHVGHTVHHHGQPPAPPPPTSSKAKPSGISTIV

SEQ ID NO: 30036 - protein, 1182 aa, Homo sapiens
  ENSP00000437554
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVSIHNRLQTSQHNSGLGAERGAPVPPPDLQPSPPRQQTPPLPPPPPTPPGTLVQCQQIVKVIVLDKPCLARMEPLLSQALSCYTSSSSDSCGSTPLGGPGSPVKVTHQPPLPPPPPPYNHPHQFCPPGSLLHGHRYSSGSRSLV

SEQ ID NO: 30037 - protein, 759 aa, Homo sapiens
  ENSP00000372292
MLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVEVLINASPARLTILPISRDTIKSYC

SEQ ID NO: 30038 - protein, 1038 aa, Homo sapiens
  ENSP00000461496
MESLLENPVRAVLYLKELTAIVQNQQSLIHTQRERIDELERRLDELSAENRSLWEHQQLLQAQPPPGLVPPSSAPLPAAPATAPAAAARAQEPLQDQGQRSAAAPHPAPDRPPRQHHGQLLEQPQRGPGSRAHTPQSPHKHLGTQGAVTDKEKERPPSCCAAAGALLQHKSPSALGKGVLSRRPENETVLHQFCCPAADACSDLASQSDGSCTQAGGGMEDSVVAAAAVAAGRPSAHAPKAQAQELQEEEERPGAGAASPRAGPQHKASPGRQQPALATALCPHAPAASDYELSLDLKNKQIEMLEHKYGGHLVSRRAACTIQTAFRQYQLSKNFEKIRNSLLESRLPRRISLRKVRSPTAESLAAEKALMEGYGLVGLPLVRSPSLPPTFAGTLTELEDSFTEQVQSLAKSIDDALSTWSLKTMCSLRESGAYQLHQALQAAAGPPGLEAEGRAPESAGPGPGDDAAETPGLPPAHSGTLMMAFRDVTVQIANQNISVSSSTALSVANCLGAQTVQAPAEPAAGKAEQGETSGREAPEAPAVGREDASAEDSCAEAAASGAADGATAPKTEEEEEEEETAEVGRGAEAEAGDLEQLSSSSTSTKSAKSGSEASASASKDALQAMILSLPRYHCENPASCKSPTLSTDTLRKRLYRIGLNLFNINPDKGIQFLISRGFIPDTPIGVAHFLLQRKGLSRQMIGEFLGNSKKQFNRDVLDCVVDEMDFSSMELDEALRKFQAHIRVQGEAQKVERLIEAFSQRYCMCNPEVVQQFHNPDTIFILAFAIILLNTDMYSPNIKPDRKMMLEDFIRNLRGVDDGADIPRELVVGIYERIQQKELKSNEDHVTYVTKVEKSIVGMKTVLSVPHRRLVCCSRLFEVTDVNKLQKQAAHQREVFLFNDLLVILKLCPKKKSSSTYTFCKSVGLLGMQFQLFENEYYSHGITLVTPLSGSEKKQVLHFCALGSDEMQKFVEDLKESIAEVTELEQIRIEWELEKQQGTKTLSFKPCGAQGDPQSKQGSPTAKREAALRERPAESTVE

SEQ ID NO: 30039 - protein, 759 aa, Homo sapiens; identical to SEQ ID NO: 30037
  ENSP00000461043

SEQ ID NO: 30040 - protein, 625 aa, Homo sapiens
  ENSP00000256458
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 30041 - protein, 480 aa, Homo sapiens
  ENSP00000305244
MSFPQLGYPQYLSAAGPGAYGGERPGVLAAAAAAAAAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQPPVAIAPGALNGDKASVRSSPTLPERDLVPRPDSPAQQLKSPFQPVRDNSLAPQEGTPRILAALPSA

SEQ ID NO: 30042 - protein, 471 aa, Homo sapiens
  ENSP00000372056
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 30043 - protein, 471 aa, Homo sapiens; identical to SEQ ID NO: 30042
  ENSP00000307006

SEQ ID NO: 30044 - protein, 483 aa, Homo sapiens
  ENSP00000378132
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 30045 - protein, 263 aa, Homo sapiens
  ENSP00000453660
MSYPQGYLYQPSASLALYSCPAYSTSVISGPRTDELGRSSSGSAFSPYAGSTAFTAPSPGYNSHLQYGADPAAAAAAAFSSYVLLKKEKKSLDFPCFPPLRPTCVRSPAERGVASVAQASICMEGRAAVARSAHGGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 30046 - protein, 482 aa, Homo sapiens
  ENSP00000316250
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 30047 - protein, 146 aa, Homo sapiens [sequence omitted]

SEQ ID NO: 30048 - protein, 46 aa, Homo sapiens
  ENSP00000463628
MEAAAQFFVESPDVVYGPEAIEAQYEYRTTRVSREGGVLKAGTSRR

SEQ ID NO: 30049 - protein, 558 aa, Homo sapiens
  ENSP00000337746
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 30050 - protein, 504 aa, Homo sapiens
  ENSP00000415458
MEAAAQFFVESPDVVYGPEAIEAQYEYRTTRVSREGGVLKEANYYGSLTQAGTVSLGLDAEGQEVFVPFSAVLPMVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 30051 - protein, 233 aa, Homo sapiens
  ENSP00000464528
  MOD_RES (1)..(1): Any amino acid
XNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRCTPASRACVGLPPQNHMLLEHKMERPGPSLKRVGPVAATYPMLNKKGPVPAATNGCTGDANGHLQEEPPMPTT

SEQ ID NO: 30052 - protein, 430 aa, Homo sapiens
  ENSP00000475677
MVAPNDLVFDGWDISSLNLAEAMRRAKVLDWGLQEQLWPHMEALRPRPSVYIPEFIAANQSARADNLIPGSRAQQLEQIRRDIRDFRSSAGLDKVIVLWTANTERFCEVIPGLNDTAENLLRTIELGLEVSPSTLFAVASILEGCAFLNGSPQNTLVPGALELAWQHRVFVGGDDFKSGQTKVKSVLVDFLIGSGLKTMSIVSYNHLGNNDGENLSAPLQFRSKEVSKSNVVDDMVQSNPVLYTPGEEPDHCVVIKYVPYVGDSKRALDEYTSELMLGGTNTLVLHNTCEDSLLAAPIMLDLALLTELCQRVSFCTDMDPEPQTFHPVLSLLSFLFKAPLVPPGSPVVNALFRQRSCIENILRACVGLPPQNHMLLEHKMERPGPSLKRVGPVAATYPMLNKKGPVPAATNGCTGDANGHLQEEPPMPTT

SEQ ID NO: 30053 - protein, 151 aa, Homo sapiens
  ENSP00000464209
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDAGADPQGHPRLPV

SEQ ID NO: 30054 - protein, 46 aa, Homo sapiens; identical to SEQ ID NO: 30048
  ENSP00000463271

SEQ ID NO: 30055 - protein, 177 aa, Homo sapiens
  ENSP00000462001
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKLEQIRRDIRDFRSSAGLDKVIVLWTANTERFCEVIPGLNDTAENLLRTIELGLEVSPSTLFAVASILEGCAFLNGSPQNTLVP

SEQ ID NO: 30056 - protein, 182 aa, Homo sapiens
  ENSP00000463500
MEAAAQFFVESPDVVYGPEAIEAQYEYRTTRVSREGGVLKVDQGAEEGGVLGRAGRLGEKGTGPGIHCAACLQVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLAE

SEQ ID NO: 30057 - protein, 148 aa, Homo sapiens
  ENSP00000464430
MEAAAQFFVESPDVVYGPEAIEAQYEYRTTRVSREGGVLKVHPTSTRFTFRTARQVPRLGVMLVGWGGNNGSTLTAAVLANRLRLSWPTRSGRKEANYYGSLTQAGTVSLGLDAEGQEVFVPFSAVLPMVAPNDLVFDGWDISSLNLA

SEQ ID NO: 30058 - protein, 1189 aa, Homo sapiens
  ENSP00000403392
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEVANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 30059 - protein, 1188 aa, Homo sapiens
  ENSP00000327290
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 30060 - protein, 1181 aa, Homo sapiens
  ENSP00000296585
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 30061 - protein, 175 aa, Homo sapiens
  ENSP00000426489
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQRGVNSVCQ

SEQ ID NO: 30062 - protein, 54 aa, Homo sapiens
  ENSP00000422095
MGPERTGAAPLPLLLVLALSQGYWLVHPGVAFLRTEWEMCINVLLTYPLPHVKN

SEQ ID NO: 30063 - protein, 815 aa, Homo sapiens
  ENSP00000424397
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQLMGQK

SEQ ID NO: 30064 - protein, 641 aa, Homo sapiens
  ENSP00000424642
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQLLCTIISCQTCSFRKSWDPMEPLGAISSTLGGPWMAMEI

SEQ ID NO: 30065 - protein, 942 aa, Homo sapiens
  ENSP00000422145
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKEGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTR

SEQ ID NO: 30066 - protein, 195 aa, Homo sapiens
  ENSP00000340149
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQGSISKYRART

SEQ ID NO: 30067 - protein, 1032 aa, Homo sapiens [sequence omitted]

SEQ ID NO: 30068 - protein, 614 aa, Homo sapiens
  ENSP00000233573
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKK

SEQ ID NO: 30069 - protein, 1049 aa, Homo sapiens
  ENSP00000293379
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 30070 - protein, 119 aa, Homo sapiens
  ENSP00000450267
  MOD_RES (1)..(1): Any amino acid
XREAPSRSSASSGPQILREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 30071 - protein, 137 aa, Homo sapiens
  ENSP00000405865
MGSRTPESPLHAVQLRWGPRRRPPLLPLLLLLLPPPPRVGGFNLDAEAPAVLSGPPGSFFGFSVEFYRPGTDGLSAPGVLTVQLRGRGACGVQVLAVVRGNSSSPWLLHLGMRSTVQLAHREGATERPRGHLLPLHR

SEQ ID NO: 30072 - protein, 120 aa, Homo sapiens
  ENSP00000447347
  MOD_RES (1)..(1): Any amino acid
XLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGMRSTVQLAHREGATERPRGHLLPLHR

SEQ ID NO: 30073 - protein, 1141 aa, Homo sapiens
  ENSP00000452120
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 30074 - protein, 1137 aa, Homo sapiens
  ENSP00000257879
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 30075 - protein, 109 aa, Homo sapiens
  ENSP00000450693
  MOD_RES (1)..(1): Any amino acid
XVKDKLRAIVVTLSYSLQTPRLRRQAPGQGLPPVAPILNAHQPSTQRAEIHFLKQGCGEDKICQSNLQLVRARFCTRVSDTEFQPLPMRSHSACPMRMPPMLSVSWGTP

SEQ ID NO: 30076 - protein, 1131 aa, Homo sapiens
  ENSP00000343009
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 30077 - protein, 1044 aa, Homo sapiens
  ENSP00000393844
MAPFATPMVQALTTTRIQRQAEGFQCWRECGTRRSPFEGKETCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 30078 - protein, 1181 aa, Homo sapiens
  ENSP00000452387
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 30079 - protein, 205 aa, Homo sapiens
  ENSP00000451039
  MOD_RES (1)..(1): Any amino acid
XCAACLGPSLEQHLSGGVLSCEVPGSDCPGQHHSEVLHKELDAPRCLHSDPSDGILGPHGCGGRRSALVGHPPGCTGWAAGASTAGAAPVEVWLLPSEQPELIFSHQLSPGLSGCAAFSHGSWGSRDCGMGFFKRAKHPEATVPQYHAVKIPREDRQQFKEEKTGTILRNNWGSPRREGPDAHPILAADGHPELGPDGHPGPGTA

SEQ ID NO: 30080 - protein, 98 aa, Homo sapiens
  ENSP00000450679
MVQALTTTRIQRQAEGFQCWRGFSIDSGKGLVRAEELSFVAGAPRANHKGAVVILRKDSASRLVPEVMLSGERLTSGFGYSLAVADLNSDGYCSGCPL

SEQ ID NO: 30081 - protein, 153 aa, Homo sapiens
  ENSP00000450578
MIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVML

SEQ ID NO: 30082 - protein, 55 aa, Homo sapiens
  ENSP00000451311
MAPFATPMVQALTTTRIQRQAEGFQCWRGCWWVLPRPWLFLGSRRIALEASSLAR

SEQ ID NO: 30083 - protein, 35 aa, Homo sapiens
  ENSP00000452043
  MOD_RES (1)..(1): Any amino acid
XEGFQCWRGCWWVLPRPWLFLGSRRIALEASSLAR

SEQ ID NO: 30084 - protein, 48 aa, Homo sapiens
  ENSP00000452467
MVQALTTTRIQRQAEGFQCWRGCWWVLPRPWLFLGSRRIALEASSLAR

SEQ ID NO: 30085 - protein, 48 aa, Homo sapiens; identical to SEQ ID NO: 30084
  ENSP00000450798

SEQ ID NO: 30086 - protein, 1063 aa, Homo sapiens
  ENSP00000367316
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPLWVIILAILLGLLVLAILTLALWKCGFFDRARPPQEDMTDREQLTNDKTPEA

SEQ ID NO: 30087 - protein, 632 aa, Homo sapiens
  ENSP00000397258
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQVRTLKLILSTQGGSCTEQK

SEQ ID NO: 30088 - protein, 1035 aa, Homo sapiens
  ENSP00000264741
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 30089 - protein, 69 aa, Homo sapiens
  ENSP00000406533
  MOD_RES (1)..(1): Any amino acid
XKKDSSSVIQFMSRAKVKVDPALRVVEIAHGNPEEVTMGFFRRRYKEIIEAEKNRKENEDSWDWVQKNQ

SEQ ID NO: 30090 - protein, 1048 aa, Homo sapiens
  ENSP00000261023
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 30091 - protein, 1012 aa, Homo sapiens
  ENSP00000364042
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSRQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 30092 - protein, 1002 aa, Homo sapiens
  ENSP00000404291
MLLGTLLLILYILMLCRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 30093 - protein, 136 aa, Homo sapiens
  ENSP00000389442
  MOD_RES (1)..(1): Any amino acid
XNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVSHWFRQIE

SEQ ID NO: 30094 - protein, 1752 aa, Homo sapiens
  ENSP00000463651
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 30095 - protein, 1822 aa, Homo sapiens
  ENSP00000200181
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 30096 - protein, 1752 aa, Homo sapiens; identical to SEQ ID NO: 30094
  ENSP00000405536

SEQ ID NO: 30097 - protein, 1805 aa, Homo sapiens
  ENSP00000400217
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 30098 - protein, 114 aa, Homo sapiens
  ENSP00000463788
SNSMSDDLDNLKKMGQNLARVLSQLTSDYTIGFGKFVDKVSVPQTDMRPEKLKEPWPNSDPPFSFKNVISLTEDVDEFRNKLQGERISATPSLHPWGPSPPACTEQGLGVSWEA

SEQ ID NO: 30099 - protein, 201 aa, Homo sapiens
  ENSP00000464259
  MOD_RES (1)..(1): Any amino acid
XTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVP

SEQ ID NO: 30100 - protein, 63 aa, Homo sapiens
  ENSP00000462494
  MOD_RES (1)..(1): Any amino acid
XARTTEGFGPEREGIITIESQDGGPFPQLGSRAGLFQHPLQSEYSSITTTHTSATEPFLVGEH

SEQ ID NO: 30101 - protein, 799 aa, Homo sapiens
  ENSP00000296181
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 30102 - protein, 401 aa, Homo sapiens
  ENSP00000420814
  MOD_RES (1)..(1): Any amino acid
XKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLRE

SEQ ID NO: 30103 - protein, 323 aa, Homo sapiens
  ENSP00000477446
IRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCR

SEQ ID NO: 30104 - protein, 263 aa, Homo sapiens
  ENSP00000418367
  MOD_RES (1)..(1): Any amino acid
XYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGT

SEQ ID NO: 30105 - protein, 40 aa, Homo sapiens
  ENSP00000418079
MTPQEIAVNLRPEQWPRVPDGGLTRDAQCLGNGLTQCCMW

SEQ ID NO: 30106 - protein, 139 aa, Homo sapiens
  ENSP00000477230
MTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPE

SEQ ID NO: 30107 - protein, 79 aa, Homo sapiens
  ENSP00000419198
MTPQEIAVNLRPGDKTTFQLQVRQVEDYPVDLYYLMDLSLSMKDDLDNIRSLGTKLAEEMRKLTSNFRLGFGSFVDKDI

SEQ ID NO: 30108 - protein, 59 aa, Homo sapiens
  ENSP00000476655
MTPQEIAVNLRPGDKTTFQLQVRQVEDYPVDLYYLMDLSLSMKDDLDNIRSLGTKLAEE

SEQ ID NO: 30109 - protein, 634 aa, Homo sapiens
  ENSP00000441561
MLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 30110 - protein, 769 aa, Homo sapiens
  ENSP00000222573
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 30111 - protein, 698 aa, Homo sapiens
  ENSP00000413922
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 30112 - protein, 890 aa, Homo sapiens
  ENSP00000415769
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 30113 - protein, 670 aa, Homo sapiens [sequence omitted]

SEQ ID NO: 30114 - protein, 263 aa, Homo sapiens
  ENSP00000362395
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 30115 - protein, 219 aa, Homo sapiens
  ENSP00000415533
MVKIAFNTPTAVQKEEARQDVEALLSRTVRTQILTGKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 30116 - protein, 260 aa, Homo sapiens
  ENSP00000396560
MNTQRNPRNGQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQG

SEQ ID NO: 30117 - protein, 461 aa, Homo sapiens
  ENSP00000260386
MTLPGGPTGMARPGGARPCSPGLERAPRRSVGELRLLFEARCAAVAAAAAAGEPRARGAKRRGGQVPNGLPRAPPAPVIPQLTVTAEEPDVPPTSPGPPERERDCLPAAGSSHLQQPRRLSTSSVSSTGSSSLLEDSEDDLLSDSESRSRGNVQLEAGEDVGQKNHWQKIRTMVNLPVISPFKKRYAWVQLAGHTGSFKAAGTSGLILKRCSEPERYCLARLMADALRGCVPAFHGVVERDGESYLQLQDLLDGFDGPCVLDCKMGVRTYLEEELTKARERPKLRKDMYKKMLAVDPEAPTEEEHAQRAVTKPRYMQWREGISSSTTLGFRIEGIKKADGSCSTDFKTTRSREQVLRVFEEFVQGDEEVLRRYLNRLQQIRDTLEVSEFFRRHEVIGSSLLFVHDHCHRAGVWLIDFGKTTPLPDGQILDHRRPWEEGNREDGYLLGLDNLIGILASLAER

SEQ ID NO: 30118 - protein, 946 aa, Homo sapiens
  ENSP00000272117
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 30119 - protein, 644 aa, Homo sapiens
  ENSP00000355748
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRV

SEQ ID NO: 30120 - protein, 946 aa, Homo sapiens; identical to SEQ ID NO: 30118
  ENSP00000411152

SEQ ID NO: 30121 - protein, 127 aa, Homo sapiens
  ENSP00000455257
VALRRRPGRGPTRLASSTLGSRLRHFLPASWRGLASPSEEETPGVRVTGSGAERSGGRARRAAQAMSSCAVATLSGSASCPGLPVWRVTPPSPRDTSESRASASCWRVTTSMRCACLRTCWATARRT

SEQ ID NO: 30122 - protein, 535 aa, Homo sapiens
  ENSP00000370849
MSVHYTLNLRVFWPLVTGLCTALVCLYHVLRGSGGARAEPADGVDGGFPLLKVAVLLLLSYVLLRCRHAVRQRFLPGSPRLEGHAAFSSRHFREPGLSILLESYYEHEVRLSPHVLGHSKAHVSRIVGELVRAGRARGSPGLIPGGALALAFRGDFIQVGSAYEQHKIRRPDSFDVLVPLRLPPLVALEPRSLGEEPALAPAFRGCFLCALKAPPSPSGASGGHWLRDCKPFADAFCVDVRGRRHLSATLVLRWFQSHLQRSLATVRYSLEGRCRVTLTPGGLEQPPTLHILPCRTDYGCCRLSMAVRLIPAVHLGDGVFLVAPPPPPLPSAPLLELPEGLRAEALWGVNTARQEQKLLSWLQERAAPGACYLKCLQLLKALRDLGARGLDSAAATQWGRILSSYVLKTVLLAVLLRKGAPGQGWDEEHLGRCLEELVQFLRDCLLRRHTLFHCVLGPGGAAAEVGPLPKALREAAPVDLLAAFDGHARELAAARLLSTWQRLPQLLRAYGGPRYLARCPPPRSQRTQGFLEGEP

SEQ ID NO: 30123 - protein, 1670 aa, Homo sapiens
  ENSP00000354561
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 30124 - protein, 1697 aa, Homo sapiens
  ENSP00000347244
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 30125 - protein, 55 aa, Homo sapiens
  ENSP00000395682
  MOD_RES (1)..(1): Any amino acid
XELHGFLFNDFLLLTYMVKQFAVSSGSEKLFSSKSNAQFKMYKTDRLGAEDQGGV

SEQ ID NO: 30126 - protein, 36 aa, Homo sapiens
  ENSP00000411319
  MOD_RES (1)..(1): Any amino acid
XAWVQKIKAASEQYIDTEKKKREKAYQGFPHFVIYS

SEQ ID NO: 30127 - protein, 1249 aa, Homo sapiens
  ENSP00000384499
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVRRLLLASSRGICCLS

SEQ ID NO: 30128 - protein, 120 aa, Homo sapiens
  ENSP00000389013
  MOD_RES (1)..(1): Any amino acid
XLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQ

SEQ ID NO: 30129 - protein, 609 aa, Homo sapiens
  ENSP00000391224
MMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSRSWSSGSSAHSPATHRAPLSSPVPNSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKK

SEQ ID NO: 30130 - protein, 183 aa, Homo sapiens
  ENSP00000391715
MWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMM

SEQ ID NO: 30131 - protein, 1680 aa, Homo sapiens
  ENSP00000479408
MAESQGKLRTMMAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 30132 - protein, 1218 aa, Homo sapiens
  ENSP00000254958
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 30133 - protein, 172 aa, Homo sapiens
  ENSP00000481034
  MOD_RES (1)..(1): Any amino acid
XPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETSESATLWGALGCMGHVGGIPLQRGKTFFVLEISGSKTAVISALGQYHLCLICIYES

SEQ ID NO: 30134 - protein, 74 aa, Homo sapiens
  ENSP00000484139
  MOD_RES (1)..(1): Any amino acid
XCQLDANECEAKPCVNAKSCKNLIASYYCDCLPGWMGQNCDININDCLGQCQNDASCRAITVRETSMNVPATPV

SEQ ID NO: 30135 - protein, 312 aa, Homo sapiens
  ENSP00000383376
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENVQWLTPVIPALWKAAAGGSRGQEF

SEQ ID NO: 30136 - protein, 298 aa, Homo sapiens
  ENSP00000420419
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 30137 - protein, 261 aa, Homo sapiens
  ENSP00000436801
  MOD_RES (1)..(1): Any amino acid
XAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQSGRPNFGSMGVERRWMTNYLRLWQLGVEKIY

SEQ ID NO: 30138 - protein, 262 aa, Homo sapiens
  ENSP00000318416
MARRSRHRLLLLLLRYLVVALGYHKAYGFSAPKDQQVVTAVEYQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 30139 - protein, 310 aa, Homo sapiens
  ENSP00000299106
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 30140 - protein, 38 aa, Homo sapiens
  ENSP00000432455
MALRRPPRLRLCARLPDFFLLLLFRESSLVCFPRLHSK

SEQ ID NO: 30141 - protein, 124 aa, Homo sapiens
  ENSP00000433206
MALRRPPRLRLCARLPDFFLLLLFRGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDS

SEQ ID NO: 30142 - protein, 259 aa, Homo sapiens
  ENSP00000395742
MALRRPPRLRLCARLPDFFLLLLFRGCLIGAVNLKSSNRTPVVQEFESVELSCIITDSQTSDPRIEWKKIQDEQTTYVFFDNKIQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 30143 - protein, 120 aa, Homo sapiens
  ENSP00000432769
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQS

SEQ ID NO: 30144 - protein, 66 aa, Homo sapiens
  ENSP00000435145
MFCPLKLILLPVLLEHRRQMYIQDRLDSVTRRARQGRICAILLLQSQCAYWALPEPRTLDGGHLMQ

SEQ ID NO: 30145 - protein, 155 aa, Homo sapiens
  ENSP00000431791
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGC

SEQ ID NO: 30146 - protein, 220 aa, Homo sapiens
  ENSP00000492467
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRKW

SEQ ID NO: 30147 - protein, 355 aa, Homo sapiens
  ENSP00000431218
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 30148 - protein, 305 aa, Homo sapiens
  ENSP00000431614
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEVNTRFSLKH

SEQ ID NO: 30149 - protein, 394 aa, Homo sapiens
  ENSP00000348635
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 30150 - protein, 384 aa, Homo sapiens
  ENSP00000292067
MVSGDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 30151 - protein, 383 aa, Homo sapiens
  ENSP00000436117
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 30152 - protein, 230 aa, Homo sapiens
  ENSP00000388302
  MOD_RES (1)..(1): Any amino acid
XYFVLGSLIYSDAKSKKNRNCVFITDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 30153 - protein, 243 aa, Homo sapiens
  ENSP00000283928
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 30154 - protein, 173 aa, Homo sapiens
  ENSP00000387976
MWVANDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRK

SEQ ID NO: 30155 - protein, 181 aa, Homo sapiens
  ENSP00000415096
MDILSLLMFGIPLKNTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVR

SEQ ID NO: 30156 - protein, 80 aa, Homo sapiens
  ENSP00000415984
MTGIAAASFFSNTCRFGGCGLHFPTLADLIEHIEDNHIDTDPRVLEKQELQQPTYVALSYINRDIGHQMESRLNRSTVAS

SEQ ID NO: 30157 - protein, 66 aa, Homo sapiens
  ENSP00000399083
MTGIAAASFFSNTCRFGGCGLHFPTLADLIEHIEDNHIDTDPRVLEKQELQQPTYVALSYINRQRR

SEQ ID NO: 30158 - protein, 163 aa, Homo sapiens
  ENSP00000415558
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 30159 - protein, 133 aa, Homo sapiens
  ENSP00000452769
MMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLN

SEQ ID NO: 30160 - protein, 163 aa, Homo sapiens; identical to SEQ ID NO: 30158
  ENSP00000399587

SEQ ID NO: 30161 - protein, 174 aa, Homo sapiens
  ENSP00000267569
MVAGWPATPPAMMPGQIPDPSVTTGSLPGLGPLTGLPSSALTVEELKYADIRNLGAMIAPLHFLEVKLGKRPQPVKSELDEEEERRKRRREKNKVAAARCRNKKKERTEFLQRESERLELMNAELKTQIEELKQERQQLILMLNRHRPTCIVRTDSVKTPESEGNPLLEQLEKK

SEQ ID NO: 30162 - protein, 163 aa, Homo sapiens; identical to SEQ ID NO: 30158
  ENSP00000409787

SEQ ID NO: 30163 - protein, 311 aa, Homo sapiens
  ENSP00000261247
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 30164 - protein, 305 aa, Homo sapiens
  ENSP00000389699
MACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 30165 - protein, 140 aa, Homo sapiens
  ENSP00000451723
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLIYHCIYLLRILLGINDAAPTSSGEEDCMWVREI

SEQ ID NO: 30166 - protein, 153 aa, Homo sapiens
  ENSP00000451076
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPL

SEQ ID NO: 30167 - protein, 325 aa, Homo sapiens
  ENSP00000450749
MKGEIQQSLGAWVLLTVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 30168 - protein, 247 aa, Homo sapiens
  ENSP00000450813
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIE

SEQ ID NO: 30169 - protein, 319 aa, Homo sapiens
  ENSP00000348351
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 30170 - protein, 213 aa, Homo sapiens
  ENSP00000479775
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLL

SEQ ID NO: 30171 - protein, 988 aa, Homo sapiens
  ENSP00000379441
MSFALEETLESDWVAVRPHVFDEREKHKFVFIVAWNEIEGKFAITCHNRTAQRQRSGSREQAGARGGAEAGGAASDGSRGPGSPAGRGRPEATASATLVRSPGPRRSSAWAEGGSPRSTRSLLGDPRLRSPGSKGAESRLRSPVRAKPIPGQKTSEADDAAGAAAAAARPAPREAQVSSVRIVSASGTVSEEIEVLEMVKEDEAPLALSDAEQPPPATELESPAEECSWAGLFSFQDLRAVHQQLCSVNSQLEPCLPVFPEEPSGMWTVLFGGAPEMTEQEIDTLCYQLQVYLGHGLDTCGWKILSQVLFTETDDPEEYYESLSELRQKGYEEVLQRARKRIQELLDKHKNTESMVELLDLYQMEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 30172 - protein, 202 aa, Homo sapiens
  ENSP00000216039
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 30173 - protein, 154 aa, Homo sapiens
  ENSP00000444798
  MOD_RES (1)..(1): Any amino acid
XKGDKAKSESLELPQAAPPQIYHEKQRRELCALHALNNVFQDSNAFTRDTLQEIFQRDVGVIALTNVMGFIMNLPSSLCWGPLKLPLKRQHWICVREVGGAYYNLDSKLKMPEWIGGESELRKFLKHHLRGKNCELLLVVPEEVEAHQSWRTDV

SEQ ID NO: 30174 - protein, 123 aa, Homo sapiens
  ENSP00000410010
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKRRDVGVIALTNVMGFIMNLP

SEQ ID NO: 30175 - protein, 104 aa, Homo sapiens
  ENSP00000415189
MSCVPWKGDKAKSESLELPQAAPPQIYHEKQRRELCALHALNNVFQDSNAFTRDTLQEIFQRLSPNTMVTPHKKSMLGNGNYDVNVIMAALQTKGYEAVWWDKR

SEQ ID NO: 30176 - protein, 62 aa, Homo sapiens
  ENSP00000393131
MSCVPWKGDKAKSESLELPQAAPPQIYHEKQRRELCALHALNNVFQDSNAFTRDTLQEIFQR

SEQ ID NO: 30177 - protein, 61 aa, Homo sapiens
  ENSP00000405182
MSCVPWKGDKAKSESLELPQAAPPQIYHEKQRRELCALHALNNVFQDSNAFTRDTLQEIFQ

SEQ ID NO: 30178 - protein, 661 aa, Homo sapiens
  ENSP00000344488
MTGGRFDFDDGGTYCGGWEEGKAHGHGICTGPKGQGEYSGSWSHGFEVVGGYTWPSGNTYQGYWAQGKRHGLGVETKGKWMYRGEWSHGFKGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSRTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLMSKAPTKEAGAVVPQSKYSGRHHIPNPSNGELHSQYHGYYVKLNAPQHPPVDVEDGDGSSQSSSALVHKPSANKWSPSKSVTKPVAKESKAEPKAKKSELAIPKNPASNDSCPALEKEANSGPNSIMIVLVMLLNIGLAILFVHFLT

SEQ ID NO: 30179 - protein, 79 aa, Homo sapiens
  ENSP00000429652
MTGGRYLPGPVGRRHAAWLRRAPERALRHGHGDPLTAAYLAGLAAQRAEQWQRAPRRRSRRRQPGRHPRRFRAQLPRRR

SEQ ID NO: 30180 - protein, 748 aa, Homo sapiens
  ENSP00000284262
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 30181 - protein, 331 aa, Homo sapiens
  ENSP00000360266
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 30182 - protein, 347 aa, Homo sapiens
  ENSP00000303315
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 30183 - protein, 347 aa, Homo sapiens
  ENSP00000252818
METPFYGDEALSGLGGGASGSGGSFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 30184 - protein, 166 aa, Homo sapiens
  ENSP00000475153
AAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQREEQSVRF

SEQ ID NO: 30185 - protein, 1352 aa, Homo sapiens
  ENSP00000371740
MAHTTKVNGSASGKAGDILSGDQDKEQKDPYFVETPYGYQLDLDFLKYVDDIQKGNTIKRLNIQKRRKPSVPCPEPRTTSGQQGIWTSTESLSSSNSDDNKQCPNFLIARSQVTSTPISKPPPPLETSLPFLTIPENRQLPPPSPQLPKHNLHVTKTLMETRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 30186 - protein, 1352 aa, Homo sapiens; identical to SEQ ID NO: 30185
  ENSP00000371734

SEQ ID NO: 30187 - protein, 1194 aa, Homo sapiens
  ENSP00000371730
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 30188 - protein, 352 aa, Homo sapiens
  ENSP00000371726
ECDVIEYPLEEEEEEEDEDTRGMAEGHHAVNIEGLKSARVEDEMQVQECEPEKVEIRERYELSEKMLSACNLLKNTINDPKALTSKDMGQVQWLTPMIPTLREADAGGSHERFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 30189 - protein, 283 aa, Homo sapiens
  ENSP00000371723
  MOD_RES (1)..(1): Any amino acid
XYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPVSVVHLAFVNRLKSTRLVDPLPPGIDGRQILC

SEQ ID NO: 30190 - protein, 1352 aa, Homo sapiens; identical to SEQ ID NO: 30185
  ENSP00000477725

SEQ ID NO: 30191 - protein, 851 aa, Homo sapiens
  ENSP00000465650
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 30192 - protein, 221 aa, Homo sapiens
  ENSP00000464896
  MOD_RES (1)..(1): Any amino acid
XEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRFAPMSDDESPTSSSAEE

SEQ ID NO: 30193 - protein, 859 aa, Homo sapiens
  ENSP00000468002
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTAPPLSSPPGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSFAPMSDDESPTSSSAEE

SEQ ID NO: 30194 - protein, 841 aa, Homo sapiens
  ENSP00000467029
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGSLTPSAAGSTASLVGVGLPPPTPRSSGLSTPVPPSAGHLAHVREQMAGALRKLRQLEEQVKLIPVLQVKLSVLQEEKRQLTVQLKSQKFLGHPTAGRGRSELCLDLPDPPEDPVALETRSVGTWVRERDLGMPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNVHMVKKISITERSCDGAAGLPEVPAESSSSPPGSEVASLTQPEKSTGRVPTQEPTHREPTRQAASQESEEAGGTGGPPAGVRSIMKRKEEVADPTAHRRSLQFVGVNGGYESSSEDSSTAENISDNDSTENEAPEPRERVPSVAEAPQLRPAGTAAAKTSRQECQLSRESQHIPTAEGASGSNTEEEIRMELSPDLISACLALEKYLDNPNALTERELKVAYTTVLQEWLRLACRSDAHPELVRRHLVTFRAMSARLLDYVVNIADSNGNTALHYSVSHANFPVVQQLLDSGVCKVDKQNRAGYSPIMLTALATLKTQDDIETVLQLFRLGNINAKASQAGQTALMLAVSHGRVDVVKALLACEADVNVQDDDGSTALMCACEHGHKEIAGLLLAVPSCDISLTDRDGSTALMVALDAGQSEIASMLYSRMNIKCSVSLNPAG

SEQ ID NO: 30195 - protein, 122 aa, Homo sapiens
  ENSP00000468409
MPDGEAALAAKVAVLETQLKKALQELQAAQARQADPQPQAWPPPDSPVRVDTVRVVEGPREVEVVASTAAGAPAQRAQSLEPYGTGLRALAMPGRPESPPVFRSQEVVETMCPVPAAATSNV

SEQ ID NO: 30196 - protein, 147 aa, Homo sapiens
  ENSP00000468490
MAQVLHVPAPFPGTPGPASPPAFPAKDPDPPYSVETPYGYRLDLDFLKYVDDIEKGHTLRRVAVQRRPRLSSLPRGPGSWWTSTESLCSNASGDSRHSAYSYCGRGFYPQYGALETRGGFNPRVERTLLDARRRLEDQAATPTGLGS

SEQ ID NO: 30197 - protein, 44 aa, Homo sapiens
  ENSP00000465914
MAQVLHVPAPFPGTPGPASPPAFPAKDPDPPYSVETPYGYRLDL

SEQ ID NO: 30198 - protein, 2 aa, Homo sapiens
  ENSP00000464861
MA

SEQ ID NO: 30199 - protein, 133 aa, Homo sapiens
  ENSP00000321161
MITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 30200 - protein, 995 aa, Homo sapiens
  ENSP00000360195
MEKTDAKDQSSQGDEEKDPPKSHPYSVETPYGFHLDLDFLKYVDDIEKGNTIKRIPIHRRAKQAKFSTLPRNFSLPDSGARPPAAPPLQNWSPVVPREASLGTQEQNQSPPLGNAPQASTSRSEVSYHRKALLAEATRQLEAAEPEDAELTFGSGRPQLLRASSMPATLLHSRASEEPGLSLGPPAPPALPPLQGEGSVCDGTFEPAEGLAGFHSSSPRASTRIPELVQEGAEPPEGVVKVPNHLPLPGPPFSFQNVLVVLEDKEDEHNAREAEVLFTPGSPTPSPPPLPSPIPENELLLEEIELNISEIPPPPPVEVDMRSIGIRVTEESLGLARVDPGSISSLKQQVSALEGELSGRTEELAQVRTALQQQEEEIKAREQRIRELEFTVAQLEGQFHQENAKDTQGQTDVMVNTDPVHGLLTRESCDKGIEVNLLGSMESESWGHRGEENGLLWGPDGHKQGNQSPAERVLLPQLSLPQGPEQVLTSSVHSFLSTELRIEEAGTEQEGGPQGGTRGAGGFLWGSDRKTPPAGREETSSNLPGKEHPGRPPSSPTDATIGQYVKKIQELLQEQWNCLEHGYPELASAIKQPASKLSSIQSQLLSSLNLLLSAYSAQAHPPKEPPASSSSPPVEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 30201 - protein, 351 aa, Homo sapiens
  ENSP00000360192
MKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 30202 - protein, 367 aa, Homo sapiens
  ENSP00000346352
MEKTDEISPSTSLKSIMKKKDYGFRAGGNGTKKNLQFVGVNGGYETTSSEETSGEDSTPEDLSDSEAEKKCDGPDHKHVKDAHLTCEAGQGIPEGTCHAAQESGPGEEVPHSKAERYKPSEEFLNACRALSQHLPETGTTTDQLLRQSLNTISQEWFRVSSRKSSSPAVVASYLHEVQPHSPHFLKLLVNLADHNGNTALHYSVSHSNFSIVKLLLETGVCNVDHQNKAGYTAVMITPLASAETNEDMAVVWKLLREGNVNIQATQGGQTALMLGVSHDREDMVQALLSCQADVNLQDHDGSSALMVACHHGNVDLVRLLLAHPACDSSLTDKAGRTALSIALKSPTHMEIAGLLRAHAEQGRSLGL

SEQ ID NO: 30203 - protein, 495 aa, Homo sapiens
  ENSP00000371985
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 30204 - protein, 441 aa, Homo sapiens
  ENSP00000492506
LAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 30205 - protein, 38 aa, Homo sapiens
  ENSP00000492218
  MOD_RES (1)..(1): Any amino acid
XEIAEQEGNQKGEQATSLAILRVIRLACTPTPGFQNWM

SEQ ID NO: 30206 - protein, 499 aa, Homo sapiens
  ENSP00000487785
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 30207 - protein, 356 aa, Homo sapiens
  ENSP00000358785
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLERRPLQSQKSKRGRQHLNTSHDCTLGINLVAGMTVQWTRASGPDDRQTPAVTTLHRMY

SEQ ID NO: 30208 - protein, 245 aa, Homo sapiens
  ENSP00000491627
MNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 30209 - protein, 113 aa, Homo sapiens
  ENSP00000492008
MNIIDIVAIIPYFITLGTELAEKPEDAQQGQQAMSLAILRVIRLERRPLQSQKSKRGRQHLNTSHDCTLGINLVAGMTVQWTRASGPDDRQVCGSSVYKYISSISLSRVPLPS

SEQ ID NO: 30210 - protein, 305 aa, Homo sapiens
  ENSP00000492716
MHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 30211 - protein, 59 aa, Homo sapiens
  ENSP00000491354
MNIIDIVAIIPYFITLGTELAEKPEDAQQGQQAMSLAILRVIRNADLCKARRVSGEGSI

SEQ ID NO: 30212 - protein, 499 aa, Homo sapiens; identical to SEQ ID NO: 30206
  ENSP00000491977

SEQ ID NO: 30213 - protein, 499 aa, Homo sapiens; identical to SEQ ID NO: 30206
  ENSP00000314520

SEQ ID NO: 30214 - protein, 499 aa, Homo sapiens; identical to SEQ ID NO: 30206
  ENSP00000491613

SEQ ID NO: 30215 - protein, 499 aa, Homo sapiens; identical to SEQ ID NO: 30206
  ENSP00000433109

SEQ ID NO: 30216 - protein, 377 aa, Homo sapiens
  ENSP00000491647
MEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 30217 - protein, 575 aa, Homo sapiens
  ENSP00000358784
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 30218 - protein, 653 aa, Homo sapiens
  ENSP00000328511
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 30219 - protein, 128 aa, Homo sapiens
  ENSP00000420755
MWLSSKAMLRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGT

SEQ ID NO: 30220 - protein, 419 aa, Homo sapiens
  ENSP00000419952
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 30221 - protein, 390 aa, Homo sapiens
  ENSP00000374287
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 30222 - protein, 408 aa, Homo sapiens
  ENSP00000418956
MHLYKPACADIPSPKLGLPKSSESALKCRWHLAVTKTQPQAACKPVRPSGAAEQKYVEKFLRVHGISLQETTRAETGMAYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 30223 - protein, 177 aa, Homo sapiens
  ENSP00000420221
MQLLLWGGRRVASAIHRCLSYSLHCLFQRYEVKTRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMA

SEQ ID NO: 30224 - protein, 401 aa, Homo sapiens
  ENSP00000305858
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 30225 - protein, 372 aa, Homo sapiens
  ENSP00000374285
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 30226 - protein, 81 aa, Homo sapiens
  ENSP00000418048
IACTEHNLKSRNGEDRLLSKQSSTAPNVVNAARAKFRTVAIIARSLGTFTPQHHISLKESTAKQTGMKYRNMGDIWRSNFR

SEQ ID NO: 30227 - protein, 304 aa, Homo sapiens [sequence omitted]

SEQ ID NO: 30228 - protein, 173 aa, Homo sapiens
  ENSP00000367351
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRQRGERAGQARVTPPCSLGRRARDASKSAGAGCHLQAQACVPSSTQALQTTRGRAPLKPPPPLAS

SEQ ID NO: 30229 - protein, 367 aa, Homo sapiens
  ENSP00000367337
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 30230 - protein, 353 aa, Homo sapiens
  ENSP00000367332
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 30231 - protein, 51 aa, Homo sapiens
  ENSP00000398395
MYPESTTGSPARLSLRQTGSPGMIYSTRYGSPKRQLQFYRNLGKSGLRVSC

SEQ ID NO: 30232 - protein, 253 aa, Homo sapiens
  ENSP00000374283
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSG

SEQ ID NO: 30233 - protein, 254 aa, Homo sapiens
  ENSP00000400285
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLK

SEQ ID NO: 30234 - protein, 395 aa, Homo sapiens
  ENSP00000473602
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVRVRGPAGQRAHPSPSPVQCILPGSSCVPGSVLGTQDAPVNHQSCAPGELAFQQEQT

SEQ ID NO: 30235 - protein, 367 aa, Homo sapiens; identical to SEQ ID NO: 30229
  ENSP00000164247

SEQ ID NO: 30236 - protein, 162 aa, Homo sapiens
  ENSP00000464860
  MOD_RES (1)..(1): Any amino acid
XTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRIFAASQPLRSSLFPSVRGNIRSSYKVGPPSSLPSKCHSESQCQGEPPPPPPWIPDTPSSCPIKFVFWQL

SEQ ID NO: 30237 - protein, 415 aa, Homo sapiens
  ENSP00000367323
MLSMTYSESLRSVSSRCHSEWALHPVRQTDTLELQRLREVRAAAQARNMESFLRMHGLSLDGCTAQRTGMKYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEGDPFSSSKSRTFIIEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 30238 - protein, 300 aa, Homo sapiens
  ENSP00000396167
MAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 30239 - protein, 122 aa, Homo sapiens
  ENSP00000465785
YAAGKAEVVLGNIIKKKGWRIFAASQPLRSSLFPSVRGCVWDRSGRAILRVSGPKSVNHPPSSGRDVSHSSGKWSPPAQTGERSPGVMEPKGRRSGAIHPSLPGAYGPFPGQGPHPPWDQLG

SEQ ID NO: 30240 - protein, 353 aa, Homo sapiens; identical to SEQ ID NO: 30230
  ENSP00000318772

SEQ ID NO: 30241 - protein, 367 aa, Homo sapiens; identical to SEQ ID NO: 30229
  ENSP00000340824

SEQ ID NO: 30242 - protein, 404 aa, Homo sapiens
  ENSP00000302719
MQVSIACTEQNLRSRSSEDRLCGPRPGPGGGNGGPAGGGHGNPPGGGGSGPKARAALVPRPPAPAGALRESTGRGTGMKYRNLGKSGLRVSCLGLGTWVTFGSQISDETAEDVLTVAYEHGVNLFDTAEVYAAGKAERTLGNILKSKGWRRSSYVITTKIFWGGQAETERGLSRKHIIEGLRGSLERLQLGYVDIVFANRSDPNCPMEEIVRAMTYVINQGLALYWGTSRWGAAEIMEAYSMARQFNLIPPVCEQAEHHLFQREKVEMQLPELYHKIGVGSVTWYPLACGLITSKYDGRVPDTCRASIKGYQWLKDKVQSEDGKKQQAKVMDLLPVAHQLGCTVAQLAIAWCLRSEGVSSVLLGVSSAEQLIEHLGALQVLSQLTPQTVMEIDGLLGNKPHSKK

SEQ ID NO: 30243 - protein, 42 aa, Homo sapiens
  ENSP00000458237
MQVSIACTEQNLRSRSSEDRLCGPRPGPGGGPQSAFPPGPSA

SEQ ID NO: 30244 - protein, 101 aa, Homo sapiens
  ENSP00000461290
MQVSIACTEQNLRSRSSEDRLCGPRPGPGGGNGGPAGGGHGNPPGGGGSGPKARAALVPRPPAPAGALRESTGRGTGMKYRYGGGRAAHPFRFPFGTPETA

SEQ ID NO: 30245 - protein, 511 aa, Homo sapiens
  ENSP00000368785
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 30246 - protein, 585 aa, Homo sapiens
  ENSP00000265969
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 30247 - protein, 504 aa, Homo sapiens
  ENSP00000491189
  MOD_RES (1)..(1): Any amino acid
XGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKGHSAEMDNSIWFFLRETEPSHVSTYGVPIEDSTFAIASWNLESLLSNRRIVYTSWTHWTKR

SEQ ID NO: 30248 - protein, 304 aa, Homo sapiens
  ENSP00000491644
DFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 30249 - protein, 182 aa, Homo sapiens
  ENSP00000491700
  MOD_RES (1)..(1): Any amino acid
XERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGHSAEMDNSIWFFLRETEPSHVSTYGVPIEDSTFAIASWNLESLLR

SEQ ID NO: 30250 - protein, 77 aa, Homo sapiens
  ENSP00000491016
KQKLPKKKKKHIPRPPQLGSPNYCKSVVNSPHHSTQSDTCPLAQEEILEINRAGISKEQMTQRRMTALSKKECQIPN

SEQ ID NO: 30251 - protein, 103 aa, Homo sapiens
  ENSP00000492663
IPRPPQLGSPNYCKSVVNSPHHSTQSDTCPLAQEEILEINRAGHSAEMDNSIWFFLRETEPSHVSTYGVPIEDSTFAIASWNLESLLSNRRIVYTSWTHWTKR

SEQ ID NO: 30252 - protein, 70 aa, Homo sapiens
  ENSP00000491345
  MOD_RES (1)..(1): Any amino acid
XPHHSTQSDTCPLAQEEILEINRAGHSAEMDNSIWFFLRETEPSHVSTYGVPIEDSTFAIASWNLESLLR

SEQ ID NO: 30253 - protein, 79 aa, Homo sapiens
  ENSP00000491247
  MOD_RES (1)..(1): Any amino acid
XPLAQEEILEINRADSKLNGEVAKAALANEDCPHIDQALTPDEGLPFTRSGTRERYGPCFLLSTGEYACPPGGGMRKGM

SEQ ID NO: 30254 - protein, 629 aa, Homo sapiens
  ENSP00000448301
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKVLYRIYHGLLTAEKGTVEFSHTKDYTGNRLLLLNVP

SEQ ID NO: 30255 - protein, 613 aa, Homo sapiens
  ENSP00000449941
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 30256 - protein, 638 aa, Homo sapiens
  ENSP00000449253
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 30257 - protein, 558 aa, Homo sapiens
  ENSP00000319877
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSDNCKEVVITGYTQAEARSLT

SEQ ID NO: 30258 - protein, 583 aa, Homo sapiens
  ENSP00000438423
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSGYEKSRSLNNIAGLAGNALRLSPVTSPYNSPCPLRRSRSPIPSIL

SEQ ID NO: 30259 - protein, 618 aa, Homo sapiens
  ENSP00000376966
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGIRNGHSILHHLDNGTKCHYLRIIF

SEQ ID NO: 30260 - protein, 613 aa, Homo sapiens; identical to SEQ ID NO: 30255
  ENSP00000298972

SEQ ID NO: 30261 - protein, 728 aa, Homo sapiens
  ENSP00000366158
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKALVTA

SEQ ID NO: 30262 - protein, 44 aa, Homo sapiens
  ENSP00000432438
MSPEDKSPITPGSRGRYSRDRACFLLTDYAPSPDGSIRKALVTA

SEQ ID NO: 30263 - protein, 757 aa, Homo sapiens
  ENSP00000434241
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 30264 - protein, 636 aa, Homo sapiens
  ENSP00000358711
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 30265 - protein, 655 aa, Homo sapiens
  ENSP00000319591
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 30266 - protein, 636 aa, Homo sapiens; identical to SEQ ID NO: 30264
  ENSP00000306923

SEQ ID NO: 30267 - protein, 494 aa, Homo sapiens
  ENSP00000295082
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 30268 - protein, 519 aa, Homo sapiens
  ENSP00000312129
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 30269 - protein, 256 aa, Homo sapiens
  ENSP00000457897
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQVSGL

SEQ ID NO: 30270 - protein, 913 aa, Homo sapiens
  ENSP00000355974
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEGLTLLPRLVSNS

SEQ ID NO: 30271 - protein, 940 aa, Homo sapiens
  ENSP00000490983
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEGLTLLPRLVSNS

SEQ ID NO: 30272 - protein, 962 aa, Homo sapiens
  ENSP00000492513
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 30273 - protein, 989 aa, Homo sapiens
  ENSP00000271751
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 30274 - protein, 962 aa, Homo sapiens; identical to SEQ ID NO: 30272
  ENSP00000492697

SEQ ID NO: 30275 - protein, 962 aa, Homo sapiens; identical to SEQ ID NO: 30272
  ENSP00000491725

SEQ ID NO: 30276 - protein, 962 aa, Homo sapiens; identical to SEQ ID NO: 30272
  ENSP00000492302

SEQ ID NO: 30277 - protein, 208 aa, Homo sapiens
  ENSP00000492609
  MOD_RES (1)..(1): Any amino acid
XHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLELLCPPPGGDFMILSALTANIREKNIFSPKVFMLRSFNFYPLQLKRINVNLSAA

SEQ ID NO: 30278 - protein, 427 aa, Homo sapiens
  ENSP00000492865
  MOD_RES (1)..(1): Any amino acid
XQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILDCVPEDQRCET

SEQ ID NO: 30279 - protein, 327 aa, Homo sapiens
  ENSP00000492803
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEHFSMPPSSGM

SEQ ID NO: 30280 - protein, 605 aa, Homo sapiens
  ENSP00000491434
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNTLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 30281 - protein, 454 aa, Homo sapiens
  ENSP00000491302
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 30282 - protein, 354 aa, Homo sapiens
  ENSP00000491019
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQHFSMPPSSGM

SEQ ID NO: 30283 - protein, 913 aa, Homo sapiens; identical to SEQ ID NO: 30270
  ENSP00000491565

SEQ ID NO: 30284 - protein, 940 aa, Homo sapiens; identical to SEQ ID NO: 30271
  ENSP00000492724

SEQ ID NO: 30285 - protein, 962 aa, Homo sapiens; identical to SEQ ID NO: 30272
  ENSP00000492350

SEQ ID NO: 30286 - protein, 989 aa, Homo sapiens; identical to SEQ ID NO: 30273
  ENSP00000492550

SEQ ID NO: 30287 - protein, 962 aa, Homo sapiens; identical to SEQ ID NO: 30272
  ENSP00000491986

SEQ ID NO: 30288 - protein, 962 aa, Homo sapiens; identical to SEQ ID NO: 30272
  ENSP00000491804

SEQ ID NO: 30289 - protein, 962 aa, Homo sapiens; identical to SEQ ID NO: 30272
  ENSP00000491578

SEQ ID NO: 30290 - protein, 208 aa, Homo sapiens; identical to SEQ ID NO: 30277
  ENSP00000492255
  MOD_RES (1)..(1): Any amino acid

SEQ ID NO: 30291 - protein, 427 aa, Homo sapiens; identical to SEQ ID NO: 30278
  ENSP00000491426
  MOD_RES (1)..(1): Any amino acid

SEQ ID NO: 30292 - protein, 327 aa, Homo sapiens; identical to SEQ ID NO: 30279
  ENSP00000491522

SEQ ID NO: 30293 - protein, 605 aa, Homo sapiens; identical to SEQ ID NO: 30280
  ENSP00000492387

SEQ ID NO: 30294 - protein, 454 aa, Homo sapiens; identical to SEQ ID NO: 30281
  ENSP00000492092

SEQ ID NO: 30295 - protein, 354 aa, Homo sapiens; identical to SEQ ID NO: 30282
  ENSP00000491901

SEQ ID NO: 30296 - protein, 988 aa, Homo sapiens
  ENSP00000321427
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 30297 - protein, 611 aa, Homo sapiens
  ENSP00000395439
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILDHLS

SEQ ID NO: 30298 - protein, 624 aa, Homo sapiens
  ENSP00000378419
MQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRGWFSMANAL

SEQ ID NO: 30299 - protein, 1196 aa, Homo sapiens
  ENSP00000331727
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 30300 - protein, 732 aa, Homo sapiens
  ENSP00000333781
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 30301 - protein, 630 aa, Homo sapiens
  ENSP00000483158
GSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 30302 - protein, 1096 aa, Homo sapiens [sequence omitted]

SEQ ID NO: 30303 - protein, 1107 aa, Homo sapiens
  ENSP00000328813
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 30304 - protein, 195 aa, Homo sapiens
  ENSP00000412141
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNVLQDP

SEQ ID NO: 30305 - protein, 225 aa, Homo sapiens
  ENSP00000366577
MSGCSKRCKLGFVKFAQTIFKLITGTLSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30306 - protein, 42 aa, Homo sapiens
  ENSP00000431053
MSGCSKRCKLGFVKFAQTIFKLITGTLSKDGVKSGTGARRAG

SEQ ID NO: 30307 - protein, 216 aa, Homo sapiens
  ENSP00000329686
MGAVMGTFSSLQTKQRRPSKDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30308 - protein, 188 aa, Homo sapiens
  ENSP00000431102
MTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30309 - protein, 241 aa, Homo sapiens
  ENSP00000414886
MGAVMGTFSSLQTKQRRPSKDKIEDELEMTMVCHRPEGLEQLEAQTNFTKRELQVLYRGFKNECPSGVVNEDTFKQIYAQFFPHGALPCLEGSPCVEFLPPSPALLFCLVDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30310 - protein, 227 aa, Homo sapiens
  ENSP00000395323
MGAVMGTFSSLQTKQRRPSKDIAWWYYQYQRDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30311 - protein, 232 aa, Homo sapiens
  ENSP00000489903
MWAEGESEGLQTLGIVVVVCSSLKLLHYLGLIDLSDDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30312 - protein, 220 aa, Homo sapiens
  ENSP00000375071
KIEDELEMTMVCHRPEGLEQLEAQTNFTKRELQVLYRGFKNECPSGVVNEDTFKQIYAQFFPHGALPCLEGSPCVEFLPPSPALLFCLVDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30313 - protein, 207 aa, Homo sapiens
  ENSP00000478151
DIAWWYYQYQRDKIEDELEMTMVCHRPEGLEQLEAQTNFTKRELQVLYRGFKNECPSGVVNEDTFKQIYAQFFPHGDASTYAHYLFNAFDTTQTGSVKFEDFVTALSILLRGTVHEKLRWTFNLYDINKDGYINKEEMMDIVKAIYDMMGKYTYPVLKEDTPRQHVDVFFQKMDKNKDGIVTLDEFLESCQEDDNIMRSLQLFQNVM

SEQ ID NO: 30314 - protein, 225 aa, Homo sapiens
  ENSP00000239118
MNRCPRRCRSPLGQAARSLYQLVTGSLSPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30315 - protein, 270 aa, Homo sapiens
  ENSP00000349055
MRGQGRKESLSDSRDLDGSYDQLTGHPPGPTKKALKQRFLKLLPCCGPQALPSVSETLAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30316 - protein, 184 aa, Homo sapiens
  ENSP00000359063
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKDENIMRSMQLFDNVI

SEQ ID NO: 30317 - protein, 177 aa, Homo sapiens
  ENSP00000411679
MWLSWTAWTMNLNCPPCVTGLRVWSSCRSKPNSRARSCRSCTGASRTNVPAELSMRRTSSRFTPSSFLKEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30318 - protein, 227 aa, Homo sapiens
  ENSP00000341624
MRGQGRKESLSDSRDLDGSYDQLTDSVDDEFELSTVCHRPEGLEQLQEQTKFTRKELQVLYRGFKNPGALSFQECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30319 - protein, 285 aa, Homo sapiens
  ENSP00000420040
MRGQGRKESLSDSRDLDGSYDQLTGHPPGPTKKALKQRFLKLLPCCGPQALPSVSEIGRVFRFLGDSSLPSALAAPASLRPHRPRLLDPDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30320 - protein, 220 aa, Homo sapiens
  ENSP00000344169
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30321 - protein, 184 aa, Homo sapiens
  ENSP00000239117
MRGQGRKESLSDSRDLDGSYDQLTDSVDDEFELSTVCHRPEGLEQLQEQTKFTRKELQVLYRGFKNECPSGIVNEENFKQIYSQFFPQGDSSTYATFLFNAFDTNHDGSVSFEEMLDIMKSIYDMMGKYTYPALREEAPREHVESFFQKMDRNKDGVVTIEEFIESCQKVQLPALYITLTWTQA

SEQ ID NO: 30322 - protein, 252 aa, Homo sapiens
  ENSP00000350733
MRGQGRKESLSDSRDLDGSYDQLTGHPPGPTKKALKQRFLKLLPCCGPQALPSVSENSVDDEFELSTVCHRPEGLEQLQEQTKFTRKELQVLYRGFKNECPSGIVNEENFKQIYSQFFPQGDSSTYATFLFNAFDTNHDGSVSFEDFVAGLSVILRGTVDDRLNWAFNLYDLNKDGCITKEEMLDIMKSIYDMMGKYTYPALREEAPREHVESFFQKMDRNKDGVVTIEEFIESCQKDENIMRSMQLFDNVI

SEQ ID NO: 30323 - protein, 225 aa, Homo sapiens
  ENSP00000371583
MSGCRKRCKREILKFAQYLLRLLTGSLHTDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 30324 - protein, 216 aa, Homo sapiens
  ENSP00000399080
MNVRRVESISAQLEEASSTGDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 30325 - protein, 229 aa, Homo sapiens
  ENSP00000371585
MNLEGLEMIAVLIVIVLFVKLLEQFGLIEAGLEDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 30326 - protein, 250 aa, Homo sapiens
  ENSP00000371587
MNVRRVESISAQLEEASSTGGFLYAQNSTKRSIKERLMKLLPCSAAKTSSPAIQNSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 30327 - protein, 188 aa, Homo sapiens
  ENSP00000423257
MATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 30328 - protein, 34 aa, Homo sapiens
  ENSP00000445321
MNVRRVESISAQLEEASSTGEAVIEHSLCTKCCP

SEQ ID NO: 30329 - protein, 188 aa, Homo sapiens; identical to SEQ ID NO: 30327
  ENSP00000351892

SEQ ID NO: 30330 - protein, 29 aa, Homo sapiens
  ENSP00000486886
MSGCRKRCKREILKFAQYLLRLLTGSLHT

SEQ ID NO: 30331 - protein, 207 aa, Homo sapiens
  ENSP00000491635
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGSPEKICFPVSCEWKDPSQYVPLKRVQYPGPMERAWKEEVGLTEQ

SEQ ID NO: 30332 - protein, 170 aa, Homo sapiens
  ENSP00000490282
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGHGKRRWD

SEQ ID NO: 30333 - protein, 64 aa, Homo sapiens
  ENSP00000491175
  MOD_RES (1)..(1): Any amino acid
XKPCLMIRVANMRKSLLIGCQVTGKLLQTHQTKEGENIRLNQAAQRRSVSLCPVNGRTQANMFL

SEQ ID NO: 30334 - protein, 248 aa, Homo sapiens
  ENSP00000491416
  MOD_RES (1)..(1): Any amino acid
XQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQGMERGGGTNRAVNHSTQNSKTGGN

SEQ ID NO: 30335 - protein, 379 aa, Homo sapiens
  ENSP00000357068
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 30336 - protein, 287 aa, Homo sapiens
  ENSP00000492249
  MOD_RES (1)..(1): Any amino acid
XGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 30337 - protein, 245 aa, Homo sapiens
  ENSP00000491337
QTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQAAQRRSVSLCPVNGRTQANMFL

SEQ ID NO: 30338 - protein, 379 aa, Homo sapiens; identical to SEQ ID NO: 30335
  ENSP00000492619

SEQ ID NO: 30339 - protein, 379 aa, Homo sapiens; identical to SEQ ID NO: 30335
  ENSP00000491250

SEQ ID NO: 30340 - protein, 433 aa, Homo sapiens
  ENSP00000463778
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 30341 - protein, 433 aa, Homo sapiens; identical to SEQ ID NO: 30340
  ENSP00000328150

SEQ ID NO: 30342 - protein, 35 aa, Homo sapiens
  ENSP00000465646
MSYYGSSYHIINADAKYPGYPPEHIIAEKRRARRR

SEQ ID NO: 30343 - protein, 418 aa, Homo sapiens
  ENSP00000465967
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 30344 - protein, 457 aa, Homo sapiens
  ENSP00000467568
MILQKCRKVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 30345 - protein, 453 aa, Homo sapiens
  ENSP00000465295
MLKMVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 30346 - protein, 64 aa, Homo sapiens
  ENSP00000466132
MSYYGSSYHIINADAKYPGYPPEHIIAEKRRARRRLLHKDGSCNVYFKHIFGEWGSYVVDIFTT

SEQ ID NO: 30347 - protein, 35 aa, Homo sapiens; identical to SEQ ID NO: 30342
  ENSP00000465163

SEQ ID NO: 30348 - protein, 418 aa, Homo sapiens; identical to SEQ ID NO: 30343
  ENSP00000283936

SEQ ID NO: 30349 - protein, 418 aa, Homo sapiens; identical to SEQ ID NO: 30343
  ENSP00000376438

SEQ ID NO: 30350 - protein, 418 aa, Homo sapiens; identical to SEQ ID NO: 30343
  ENSP00000376439

SEQ ID NO: 30351 - protein, 418 aa, Homo sapiens; identical to SEQ ID NO: 30343
  ENSP00000479817

SEQ ID NO: 30352 - protein, 501 aa, Homo sapiens
  ENSP00000295101
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 30353 - protein, 235 aa, Homo sapiens
  ENSP00000438410
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKG

SEQ ID NO: 30354 - protein, 445 aa, Homo sapiens
  ENSP00000306497
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 30355 - protein, 423 aa, Homo sapiens
  ENSP00000477437
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 30356 - protein, 336 aa, Homo sapiens
  ENSP00000355580
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 30357 - protein, 242 aa, Homo sapiens
  ENSP00000409626
VLRVLSPDLVRRLLNLAVRAFQVPKGESLNFPESTPGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVAT

SEQ ID NO: 30358 - protein, 538 aa, Homo sapiens
  ENSP00000343104
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 30359 - protein, 543 aa, Homo sapiens
  ENSP00000310568
MEDGFKGDRTEGCRSDSVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 30360 - protein, 543 aa, Homo sapiens
  ENSP00000312811
MKFPIETPRKQVNWDPKVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 30361 - protein, 156 aa, Homo sapiens
  ENSP00000452587
MAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTI

SEQ ID NO: 30362 - protein, 430 aa, Homo sapiens
  ENSP00000327611
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 30363 - protein, 408 aa, Homo sapiens
  ENSP00000282146
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 30364 - protein, 394 aa, Homo sapiens
  ENSP00000306275
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 30365 - protein, 271 aa, Homo sapiens
  ENSP00000483136
MFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 30366 - protein, 1043 aa, Homo sapiens
  ENSP00000473714
GTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30367 - protein, 1178 aa, Homo sapiens
  ENSP00000492806
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30368 - protein, 1181 aa, Homo sapiens
  ENSP00000490978
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30369 - protein, 1208 aa, Homo sapiens
  ENSP00000492241
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30370 - protein, 1142 aa, Homo sapiens
  ENSP00000492718
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30371 - protein, 1177 aa, Homo sapiens
  ENSP00000492005
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30372 - protein, 1196 aa, Homo sapiens
  ENSP00000492835
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 30373 - protein, 1242 aa, Homo sapiens
  ENSP00000491795
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYSKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30374 - protein, 1209 aa, Homo sapiens
  ENSP00000361520
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30375 - protein, 1212 aa, Homo sapiens
  ENSP00000492492
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30376 - protein, 1185 aa, Homo sapiens
  ENSP00000492559
  MOD_RES (1)..(1): Any amino acid
XSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 30377 - protein, 1239 aa, Homo sapiens
  ENSP00000492414
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30378 - protein, 1230 aa, Homo sapiens
  ENSP00000491673
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30379 - protein, 1181 aa, Homo sapiens
  ENSP00000491927
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30380 - protein, 1195 aa, Homo sapiens
  ENSP00000361485
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30381 - protein, 583 aa, Homo sapiens
  ENSP00000491902
VHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESR

SEQ ID NO: 30382 - protein, 403 aa, Homo sapiens
  ENSP00000492406
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAHCGLRTHHSGECFQLPEGLSAQGPG

SEQ ID NO: 30383 - protein, 154 aa, Homo sapiens
  ENSP00000491040
  MOD_RES (1)..(1): Any amino acid
XDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAHCGLRTHHSGECFQLPEGLSAQGPG

SEQ ID NO: 30384 - protein, 1182 aa, Homo sapiens
  ENSP00000361498
  MOD_RES (1)..(1): Any amino acid
XNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30385 - protein, 1232 aa, Homo sapiens
  ENSP00000361514
PKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYSKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30386 - protein, 1223 aa, Homo sapiens
  ENSP00000491207
  MOD_RES (1)..(1): Any amino acid
XGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30387 - protein, 1235 aa, Homo sapiens
  ENSP00000396608
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30388 - protein, 1288 aa, Homo sapiens
  ENSP00000385717
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30389 - protein, 1233 aa, Homo sapiens
  ENSP00000491156
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30390 - protein, 1233 aa, Homo sapiens
  ENSP00000361517
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30391 - protein, 1177 aa, Homo sapiens
  ENSP00000491008
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 30392 - protein, 1234 aa, Homo sapiens
  ENSP00000492510
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30393 - protein, 1234 aa, Homo sapiens
  ENSP00000491981
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30394 - protein, 1246 aa, Homo sapiens
  ENSP00000492793
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYSKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 30395 - protein, 1238 aa, Homo sapiens
  ENSP00000491435
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 30396 - protein, 1230 aa, Homo sapiens
  ENSP00000491123
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30397 - protein, 422 aa, Homo sapiens
  ENSP00000491723
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKQCLPATCPKLLLSS

SEQ ID NO: 30398 - protein, 1192 aa, Homo sapiens
  ENSP00000361480
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 30399 - protein, 1115 aa, Homo sapiens
  ENSP00000491545
MDALIIPVTMEVPCDSRGQRMWWAFLASSMVTFFGGLFIILLWRTLKYLWTVCCHCGGKTKVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 30400 - protein, 1175 aa, Homo sapiens
  ENSP00000491539
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30401 - protein, 1178 aa, Homo sapiens
  ENSP00000491463
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYSKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30402 - protein, 1142 aa, Homo sapiens
  ENSP00000385806
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30403 - protein, 357 aa, Homo sapiens
  ENSP00000492224
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKQCLPATCPKLLLSS

SEQ ID NO: 30404 - protein, 1119 aa, Homo sapiens
  ENSP00000492178
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30405 - protein, 1236 aa, Homo sapiens
  ENSP00000492075
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30406 - protein, 1128 aa, Homo sapiens
  ENSP00000491555
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 30407 - protein, 1207 aa, Homo sapiens
  ENSP00000402150
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30408 - protein, 1178 aa, Homo sapiens
  ENSP00000286627
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30409 - protein, 1236 aa, Homo sapiens
  ENSP00000286628
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30410 - protein, 1122 aa, Homo sapiens
  ENSP00000491300
EAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQGMTINGSA

SEQ ID NO: 30411 - protein, 977 aa, Homo sapiens
  ENSP00000492519
  MOD_RES (1)..(1): Any amino acid
XQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQGMTINGSA

SEQ ID NO: 30412 - protein, 1198 aa, Homo sapiens
  ENSP00000491277
  MOD_RES (1)..(1): Any amino acid
XSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQGMTINGSA

SEQ ID NO: 30413 - protein, 575 aa, Homo sapiens
  ENSP00000491131
TVCELCFVKLKLLMIAIEYKSANRESRILINPGNHLKIQEGTLGFFIASDAKEVKRPPQLCLPLAAQKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30414 - protein, 1181 aa, Homo sapiens
  ENSP00000491418
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30415 - protein, 1020 aa, Homo sapiens
  ENSP00000491166
EAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHKVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30416 - protein, 1207 aa, Homo sapiens; identical to SEQ ID NO: 30407
  ENSP00000492200

SEQ ID NO: 30417 - protein, 97 aa, Homo sapiens
  ENSP00000492172
EAQKINNGSSQADGTLKPVDEKEEAVAAEVGWMTSVKDWAGVMISAQTLTGRVLVVLVFALSIGALVIYFIDSSKFEIFKSSETDTVFRNFAVSEYS

SEQ ID NO: 30418 - protein, 1208 aa, Homo sapiens
  ENSP00000491732
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30419 - protein, 1146 aa, Homo sapiens
  ENSP00000490982
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30420 - protein, 1178 aa, Homo sapiens
  ENSP00000491920
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFARYVPEIAALILSRNKFGGTFNKHGGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30421 - protein, 1219 aa, Homo sapiens
  ENSP00000485867
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILVTGWMPYLGPRVLMTCLDIGVVCMPTDIQSTSPASIKKFKETRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30422 - protein, 1240 aa, Homo sapiens
  ENSP00000492632
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30423 - protein, 1239 aa, Homo sapiens
  ENSP00000492049
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRWEEHCSLWRLESKGNVRRLNYCRGQQTFSVKVKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30424 - protein, 1197 aa, Homo sapiens
  ENSP00000491840
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKGRKPRLQGGVIGCMFHLQPREAQKSSSALEVHKKYGDSTGTTLEEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPS

SEQ ID NO: 30425 - protein, 964 aa, Homo sapiens
  ENSP00000492153
  MOD_RES (1)..(1): Any amino acid
XAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHKVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPS

SEQ ID NO: 30426 - protein, 1161 aa, Homo sapiens
  ENSP00000491173
  MOD_RES (1)..(1): Any amino acid
XSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPS

SEQ ID NO: 30427 - protein, 459 aa, Homo sapiens
  ENSP00000490881
MIPSKILVYRHPSSRTGTELYRPGRRRKKSLGDLFHNGYRVKSGPAAPEKEEPPNFRQSLVSCCGVCASWGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLS

SEQ ID NO: 30428 - protein, 100 aa, Homo sapiens
  ENSP00000491045
  MOD_RES (1)..(1): Any amino acid
XEGTLGFFIASDAKEVKRAFFYCKACHDDITDPKRIKKCGCKRLKVAARSRYSKDPFEFKKETPNSRLVTEPGEGRLGPIPIFNNYPAALNILLYHAELS

SEQ ID NO: 30429 - protein, 208 aa, Homo sapiens
  ENSP00000388370
  MOD_RES (1)..(1): Any amino acid
XVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRQWPVLRILILTASTTRQ

SEQ ID NO: 30430 - protein, 383 aa, Homo sapiens
  ENSP00000492837
  MOD_RES (1)..(1): Any amino acid
XIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHKLRKTHGRNTTWKESQMKCTQNISPVPSWVCPSLLFVSCVL

SEQ ID NO: 30431 - protein, 99 aa, Homo sapiens
  ENSP00000491313
EAQKINNGSSQADGTLKPVDEKEEAVAAEVGWMTSVKDWAGVMISAQTLTGRVLVVLVFALSIGALVIYFIDSSKGVLTCRGVQTLPTSMLRLRKEVWA

SEQ ID NO: 30432 - protein, 190 aa, Homo sapiens
  ENSP00000492854
MRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRPPQLCLPLAAQKRCFQSDKLDIFI

SEQ ID NO: 30433 - protein, 78 aa, Homo sapiens
  ENSP00000492740
SSSSSSSVHEPKMDALIIPVTMEVPCDSRGQRMWWAFLASSMVTFFGGLFIILLWRTLKYLWTVCCHCGGKTKSGTYI

SEQ ID NO: 30434 - protein, 584 aa, Homo sapiens
  ENSP00000492236
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKL

SEQ ID NO: 30435 - protein, 91 aa, Homo sapiens
  ENSP00000492283
  MOD_RES (1)..(1): Any amino acid
XVISIKNYHPKIRIITQMLQYHNKAHLLNIPSWNWKEGDDAICLAELKLGFIAQSCLAQGLSTMLANLFSMRSFIKVSSLIQAALILHGWN

SEQ ID NO: 30436 - protein, 30 aa, Homo sapiens
  ENSP00000491374
MRVISIKNYHPKIRIITQMLQYHNKAHLLN

SEQ ID NO: 30437 - protein, 168 aa, Homo sapiens
  ENSP00000474686
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKATHFGSPEMPPAARSWSGSPPEAAVLRGASSLALEVARCRRL

SEQ ID NO: 30438 - protein, 213 aa, Homo sapiens
  ENSP00000482747
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKGCWRLRLGPGSGTHRLGCRGAGWGQPTQRGRRKLGAAGCVFCTAHLPGLGSWRWARGSTSAHTLGTCWGDEFVGSERREKSFGQGRE

SEQ ID NO: 30439 - protein, 128 aa, Homo sapiens
  ENSP00000475086
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKVL

SEQ ID NO: 30440 - protein, 1040 aa, Homo sapiens
  ENSP00000385552
MISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLIYFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30441 - protein, 1071 aa, Homo sapiens
  ENSP00000346321
MISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRWEEHCSLWRLESKGNVRRLNYCRGQQTFSVKVKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 30442 - protein, 731 aa, Homo sapiens
  ENSP00000271915
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 30443 - protein, 426 aa, Homo sapiens
  ENSP00000354764
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 30444 - protein, 418 aa, Homo sapiens
  ENSP00000351295
MFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 30445 - protein, 746 aa, Homo sapiens
  ENSP00000481848
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCESPESPAQPSGSSLPAWYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 30446 - protein, 872 aa, Homo sapiens
  ENSP00000373648
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 30447 - protein, 319 aa, Homo sapiens
  ENSP00000491165
MVAQAWRTSMRKQREEACFRFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASRCHRRKSF

SEQ ID NO: 30448 - protein, 752 aa, Homo sapiens
  ENSP00000429799
MKPAEHATMFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 30449 - protein, 860 aa, Homo sapiens
  ENSP00000428790
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 30450 - protein, 716 aa, Homo sapiens
  ENSP00000491940
MVAQAWRTSMRKQREEACFRFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSS

SEQ ID NO: 30451 - protein, 89 aa, Homo sapiens
  ENSP00000492691
  MOD_RES (1)..(1): Any amino acid
XEGQRRTPQGIGLLAKTPLSRPVKRNNAKYRRIQTLIYDALERPRGWALLYHALVFLIVLGCLILAVLTTFKEYETVSGDWLLLLTSLC

SEQ ID NO: 30452 - protein, 751 aa, Homo sapiens [sequence omitted]

SEQ ID NO: 30453 - protein, 951 aa, Homo sapiens
  ENSP00000345055
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSKFCSNKQKLFRMYTSRKQSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 30454 - protein, 822 aa, Homo sapiens
  ENSP00000486187
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 30455 - protein, 932 aa, Homo sapiens
  ENSP00000359425
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 30456 - protein, 427 aa, Homo sapiens
  ENSP00000359419
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRFVISLLLHVCL

SEQ ID NO: 30457 - protein, 923 aa, Homo sapiens
  ENSP00000485743
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 30458 - protein, 68 aa, Homo sapiens
  ENSP00000414829
LEFVMIVVFGLEFIIRIWSAGCCCRYRGWQGRLRFARKPFCVIGEYQSLRYLDYDTNILVFYLLFCNI

SEQ ID NO: 30459 - protein, 90 aa, Homo sapiens
  ENSP00000391971
EFVMIVVFGLEFIIRIWSAGCCCRYRGWQGRLRFARKPFCVIGVRNCCVIFSVSSLTPVPYGGGRVDLRKKVYHHPWALLRRILYSILLS

SEQ ID NO: 30460 - protein, 97 aa, Homo sapiens
  ENSP00000388098
  MOD_RES (1)..(1): Any amino acid
XHTCSPTNQKLSFKERVRMASPRGQSIKSRQASVGDRRSPSTDITAEGSPTKVQKSWSFNDRTRFRPSLRLKSSQPKPVIDDKGHIKINGTVILMYL

SEQ ID NO: 30461 - protein, 923 aa, Homo sapiens [sequence omitted]

SEQ ID NO: 30462 - protein, 822 aa, Homo sapiens [sequence omitted]

SEQ ID NO: 30463 - protein, 932 aa, Homo sapiens [sequence omitted]

SEQ ID NO: 30464 - protein, 942 aa, Homo sapiens [sequence omitted]

SEQ ID NO: 30465 - protein, 951 aa, Homo sapiens [sequence omitted]

SEQ ID NO: 30466 - protein, 1111 aa, Homo sapiens
  ENSP00000356403
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 30467 - protein, 1068 aa, Homo sapiens
  ENSP00000476657
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESRKIASQSQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 30468 - protein, 1135 aa, Homo sapiens
  ENSP00000294725
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 30469 - protein, 169 aa, Homo sapiens
  ENSP00000477456
  MOD_RES (1)..(1): Any amino acid
XRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFAVLKAGNPRSRCQHDPVLRRPAIARTMAEDVR

SEQ ID NO: 30470 - protein, 370 aa, Homo sapiens
  ENSP00000405474
MPYLHLDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNP

SEQ ID NO: 30471 - protein, 500 aa, Homo sapiens
  ENSP00000435954
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 30472 - protein, 500 aa, Homo sapiens; identical to SEQ ID NO: 30471
  ENSP00000297404

SEQ ID NO: 30473 - protein, 329 aa, Homo sapiens
  ENSP00000311202
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 30474 - protein, 329 aa, Homo sapiens; identical to SEQ ID NO: 30473
  ENSP00000455785

SEQ ID NO: 30475 - protein, 120 aa, Homo sapiens
  ENSP00000459104
KAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTR

SEQ ID NO: 30476 - protein, 140 aa, Homo sapiens
  ENSP00000454282
YYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKCIVHAKVCGPS

SEQ ID NO: 30477 - protein, 81 aa, Homo sapiens
  ENSP00000460526
  MOD_RES (1)..(1): Any amino acid
XILNYLRDGSVPLPESTRELGELLGEARYYLVQGLIEDCQLALQSRAYSGFSSCSRNVFLQLVHQTRVQSRSSRCIWLSAS

SEQ ID NO: 30478 - protein, 209 aa, Homo sapiens
  ENSP00000458486
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQVRAFGVPMPMFLGELPKQVLEQKKGDMGYGLESLALAGHNPREFEVPSSASLPPQAAPPPQPHARTFAMVK

SEQ ID NO: 30479 - protein, 815 aa, Homo sapiens
  ENSP00000259154
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRIKESSGWQQVFTSPYLDWTIERVALNAKVVGGPHGDKDKMVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 30480 - protein, 213 aa, Homo sapiens
  ENSP00000396726
  MOD_RES (1)..(1): Any amino acid
XFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRVFWLGTVGHACNPSTLGGRDGWSSRSARPTW

SEQ ID NO: 30481 - protein, 168 aa, Homo sapiens
  ENSP00000399962
  MOD_RES (1)..(1): Any amino acid
XALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKSLCGVSLVSRSSQEPT

SEQ ID NO: 30482 - protein, 214 aa, Homo sapiens
  ENSP00000216014
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 30483 - protein, 220 aa, Homo sapiens
  ENSP00000386918
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKGRSWDDSNADTGLRSYSSI

SEQ ID NO: 30484 - protein, 1560 aa, Homo sapiens
  ENSP00000364550
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 30485 - protein, 1559 aa, Homo sapiens
  ENSP00000385394
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 30486 - protein, 1557 aa, Homo sapiens
  ENSP00000364528
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 30487 - protein, 1516 aa, Homo sapiens
  ENSP00000364532
MEPGSDDFLPPPECPVFEPSWAEFRDPLGYIAKIRPIAEKSGICKIRPPADWQPPFAVEVDNFRFTPRIQRLNELEIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 30488 - protein, 53 aa, Homo sapiens
  ENSP00000409757
MEPGSDDFLPPPECPVFEPSWAEFRDPLGYIAKIRPIAEKSGICKIRPPAAGV

SEQ ID NO: 30489 - protein, 99 aa, Homo sapiens
  ENSP00000407277
MEPGSDDFLPPPECPVFEPSWAEFRDPLGYIAKIRPIAEKSGICKIRPPADWQPPFAVEVDNFRFTPRIQRLNELEFQLLRRLRQEDHLSPGGQVYSQP

SEQ ID NO: 30490 - protein, 74 aa, Homo sapiens
  ENSP00000344004
MEPGSDDFLPPPECPVFEPSWAEFRDPLGYIAKIRPIAEKSGICKIRPPASGIPALTPTPWGFLPCLFLYQAGV

SEQ ID NO: 30491 - protein, 1379 aa, Homo sapiens
  ENSP00000445176
MEPGSDDFLPPPECPVFEPSWAEFRDPLGYIAKIRPIAEKSGICKIRPPAIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIPESLDFCILTPRYCSDLSSWGPAPGVFPPW

SEQ ID NO: 30492 - protein, 1539 aa, Homo sapiens
  ENSP00000322408
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 30493 - protein, 1482 aa, Homo sapiens
  ENSP00000372256
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 30494 - protein, 1476 aa, Homo sapiens
  ENSP00000398543
MEPGCDEFLPPPECPVFEPSWAEFQDPLGYIAKIRPIAEKSGICKIRPPADWQPPFAVEVDNFRFTPRVQRLNELEIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSG

SEQ ID NO: 30495 - protein, 293 aa, Homo sapiens
  ENSP00000389433
LPNIQALKEALTKAQAWIADVDEIQNGDHYPCLDDLEGLVAVGRDLPVGLEELRQLELQVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACD

SEQ ID NO: 30496 - protein, 425 aa, Homo sapiens
  ENSP00000416377
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMP

SEQ ID NO: 30497 - protein, 1570 aa, Homo sapiens
  ENSP00000444293
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKRQSLTVLTRLISSFWAQAVLPPWPPKVLGLQEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 30498 - protein, 732 aa, Homo sapiens
  ENSP00000347409
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 30499 - protein, 184 aa, Homo sapiens
  ENSP00000419889
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEEIFREYLTYL

SEQ ID NO: 30500 - protein, 204 aa, Homo sapiens
  ENSP00000420011
MGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVI

SEQ ID NO: 30501 - protein, 186 aa, Homo sapiens
  ENSP00000418886
  MOD_RES (1)..(1): Any amino acid
XQKSCPHWRGGNEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEE

SEQ ID NO: 30502 - protein, 732 aa, Homo sapiens; identical to SEQ ID NO: 30498
  ENSP00000477793

SEQ ID NO: 30503 - protein, 184 aa, Homo sapiens; identical to SEQ ID NO: 30499
  ENSP00000488896

SEQ ID NO: 30504 - protein, 204 aa, Homo sapiens; identical to SEQ ID NO: 30500
  ENSP00000488564

SEQ ID NO: 30505 - protein, 186 aa, Homo sapiens; identical to SEQ ID NO: 30501
  ENSP00000488333
  MOD_RES (1)..(1): Any amino acid

SEQ ID NO: 30506 - protein, 59 aa, Homo sapiens
  ENSP00000428643
  MOD_RES (1)..(1): Any amino acid
XNSYSTPAQSGADYYDYGHGLSEETYDSYGQEEWTNSRHKAPSARTAKGVYRDQPYGRY

SEQ ID NO: 30507 - protein, 195 aa, Homo sapiens
  ENSP00000427841
  MOD_RES (1)..(1): Any amino acid
XLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYGKKSGLTQDTR

SEQ ID NO: 30508 - protein, 196 aa, Homo sapiens
  ENSP00000427851
  MOD_RES (1)..(1): Any amino acid
XLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYWC

SEQ ID NO: 30509 - protein, 160 aa, Homo sapiens
  ENSP00000430284
MHEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVR

SEQ ID NO: 30510 - protein, 119 aa, Homo sapiens
  ENSP00000428607
MHEIEKFQKGEGKDEEKYIDVVINKNMKLGQKVLIPVKQFPKDYDDGYGTAYDEQSYDSYDNSYSTPAQSGADYYDYGHGLSEETYDSYGQEEWTNSRHKAPSARTAKGVYRDQPYGRY

SEQ ID NO: 30511 - protein, 265 aa, Homo sapiens
  ENSP00000431022
MEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYST

SEQ ID NO: 30512 - protein, 346 aa, Homo sapiens
  ENSP00000348108
MEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 30513 - protein, 520 aa, Homo sapiens
  ENSP00000297063
MAGCTRKLTHLRKRIHRPRRRTTRRWKRWFKFRKRKGEKRPRPNHKAVARRAKLKFSTSEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30514 - protein, 507 aa, Homo sapiens
  ENSP00000344805
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30515 - protein, 469 aa, Homo sapiens
  ENSP00000319251
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30516 - protein, 517 aa, Homo sapiens
  ENSP00000390837
MLESIRVTEKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30517 - protein, 417 aa, Homo sapiens
  ENSP00000389985
MKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQSINIMELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30518 - protein, 275 aa, Homo sapiens
  ENSP00000390183
MELTLQKYGSYEKFEQATGGSLLSKTRIWSHVRKYMMKEGCLGEIVVHLTEDLLSRASMTVVNGCPTLTINVSTAREHWLEGMLRHEIGTHYFRGINNLQQPWNSWTGRKKHELKPNNPTEEGLASIHSVLFRKDPFLWRAALLYYTVYQASQMSFCELFKDIGRFVKDPNTRWDYCVRAKRGWTDTSQPGCFSKDQVYLDGILQILRYRDTIDFHLLTALGKVSYEDVDRLKGLAVTENMRVPHFLQDHGRYMEHLEKIMEVNELTDRELKDLI

SEQ ID NO: 30519 - protein, 97 aa, Homo sapiens
  ENSP00000399935
MELTLQKYGSYEKFEQATGGSLLSKTRIWSHVRKYMMKEGCLGEIVVHLTEDLLSRASMTVVNGCPTLTINVSTAREHWLEGMLRHEIGTHYFRGIN

SEQ ID NO: 30520 - protein, 304 aa, Homo sapiens
  ENSP00000400749
MVATGWARRSGLHPAPRPLRGAQEALAKNLWREERNRPLILSSLIIKKLHWPEQELAKKSILNAEDSLIIDNKRSISHLSSGVLKDIFTTGTSSYNVLLQSKEEKKYHSQKQSSSTYSKRCRKPSKSPNTSRSKDPRRMKALVPVTSSGTWYCLERRPAVFVTSSVSSPVKFTHDISVTGNGIVLPPKPKSKVKWCHFSTLPKPKPQLSRSFEKGDDFSGKKFCILTAIKPTNLEKEKLRFFKSDYTYNPQFEYANPALPSVLAKHSHASDRFLKQVKCHFNSGSSFLCTKTIICDLISKNKDI

SEQ ID NO: 30521 - protein, 141 aa, Homo sapiens
  ENSP00000390527
MAGCTRKLTHLRKRIHRPRRRTTRRWKRWFKFRKRKGEKRPRPNHKAVARRAKLKFSTSGNGIVLPPKPKSKVKWCHFSTLPKPKPQLSRSFEKGDDFSGKKFCILTAIKPTNLEKEKLRFFKSDYTYNPQFEYANPALPS

SEQ ID NO: 30522 - protein, 205 aa, Homo sapiens
  ENSP00000459322
  MOD_RES (1)..(1): Any amino acid
XSGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGVL

SEQ ID NO: 30523 - protein, 408 aa, Homo sapiens
  ENSP00000457099
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPARTRCTWTASCAFCDIARPSISRC

SEQ ID NO: 30524 - protein, 471 aa, Homo sapiens
  ENSP00000290881
MVLDSGAQAYDQAPPSPPTSPPSLRHRLKPSDRDGPPLYPWSQSLALPLALAVPPALQPQPEQQPFSQMLLGHRGHMRRSESTYSVNSTGRRGRGTLGRPPPGRGRNPGGGTLRPAASLPHIAKTQRDAGHIASKSPCMLVALRPTNMDRERDKFFQSHYTYNPQFEYQEPMPTAVLEKYCEASGQFIHQAVGIIEAVLEKFGTYEHFEAATGGQLLTKCQIWSIVRKYMQKEGCAGEVVVQLSEDLLSQAVMMVENSRPTLAINLTGARQYWLEGMLRHEIGTHYLRGVNNARQPWHNAEGRLRYGLRPANPTEEGLASLHSVLFRKQPFLWRAALLYYTIHRAARMSFRQLFQDLERYVQDADVRWEYCVRAKRGQTDTSLPGCFSKDQVYLDGIVRILRHRQTIDFPLLTSLGKVSYEDVDHLRPHGVLDNTRVPHFMQDLARYRQQLEHIMATNRLDEAELGRLLPD

SEQ ID NO: 30525 - protein, 471 aa, Homo sapiens; identical to SEQ ID NO: 30524
  ENSP00000456838

SEQ ID NO: 30526 - protein, 196 aa, Homo sapiens
  ENSP00000443288
MDHEAAQLEKQHVHNVYESTAPYFSDLQSKAWPRVRQFLQEQKPGSLIADIGCGTGKYLKVNSQVHTVGCDYCGPLVEIARNRGCEAMGLEHPWIWYPRASWNQPPTDIEGPQYFYPPCHPIPDLQKQTIICHFKGPTLNEQQKSSPTHHRLHACFQHCREEESRPWLMALSSWDQVAMEGHVSASLTSCIVRLLL

SEQ ID NO: 30527 - protein, 454 aa, Homo sapiens
  ENSP00000432695
MDHEAAQLEKQHVHNVYESTAPYFSDLQSKAWPRVRQFLQEQKPGSLIADIGCGTGKYLKVNSQVHTVGCDYCGPLVEIARNRGCEAMVCDNLNLPFRDEGFDAIISIGVIHHFSTKQRRIRAIKEMARVLVPGGQLMIYVWAMEQKNRHFEKQDVLVPWNRALCSQLFSESSQSGRKRQCGYPERGHPYHPPCSECSCSVCFKEQCGSKRSHSVGYEPAMARTCFANISKEGEEEYGFYSTLGKSFRSWFFSRSLDESTLRKQIERVRPLKNTEVWASSTVTVQPSRHSSLDFDHQEPFSTKGQSLDEEVFVESSSGKHLEWLRAPGTLKHLNGDHQGEMRRNGGGNFLDSTNTGVNCVDAGNIEDDNPSASKILRRISAVDSTDFNPDDTMSVEDPQTDVLDSTAFMRYYHVFREGELCSLLKENVSELRILSSGNDHGNWCIIAEKKRGCD

SEQ ID NO: 30528 - protein, 60 aa, Homo sapiens
  ENSP00000468715
MDHEAAQLEKQHVHNVYESTAPYFSDLQSKAWPRVRQFLQEQKPGSLIADIGNQAASSLT

SEQ ID NO: 30529 - protein, 60 aa, Homo sapiens; identical to SEQ ID NO: 30528
  ENSP00000466330

SEQ ID NO: 30530 - protein, 54 aa, Homo sapiens
  ENSP00000431717
MDHEAAQLEKQHVHNVYESTAPYFSDLQSKAWPRVRQFLQEQKPGSLIADIGCG

SEQ ID NO: 30531 - protein, 199 aa, Homo sapiens
  ENSP00000370568
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLLYYSAMNYDICKVYLARWGIQGRWMKQDPRRWGNPARAPRPGQRAPQPQPPPGPLPQAPQAVHTLRGDAHSPPLMTFQSSSA

SEQ ID NO: 30532 - protein, 199 aa, Homo sapiens; identical to SEQ ID NO: 30531
  ENSP00000370568

SEQ ID NO: 30533 - protein, 1749 aa, Homo sapiens
  ENSP00000368091
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQGGTTSR

SEQ ID NO: 30534 - protein, 801 aa, Homo sapiens
  ENSP00000425616
EVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQGGTTSR

SEQ ID NO: 30535 - protein, 1805 aa, Homo sapiens
  ENSP00000259711
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 30536 - protein, 1757 aa, Homo sapiens
  ENSP00000368120
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 30537 - protein, 1770 aa, Homo sapiens
  ENSP00000368103
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 30538 - protein, 1845 aa, Homo sapiens
  ENSP00000490031
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNGGFPIISLSAWWSSPWWSYLKILFPLMWFQTKLLHKHWDKDPVQNVVQVLEKQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNSKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 30539 - protein, 889 aa, Homo sapiens
  ENSP00000351150
  MOD_RES (1)..(1): Any amino acid
XQYLEEKRSALEEQRLMYERELEQLRQQLSPDRQPQSSGPDRLAYSSQTAQQKVTQWAEERDELFRQSLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVTFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQEVNA

SEQ ID NO: 30540 - protein, 270 aa, Homo sapiens
  ENSP00000422808
LEFISDGALAIEVWGHRCAGNGSSIWEVDSLHAKTRTLHDRWNEVTRRIEMWISILELNELGEYAAVELHQAKDVNTGGIFQLRQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDLSANEQLVGPHASGVNSILPKEHGSQFFYLPIIKHSDDEVSATASWDSSVHDSVHLNRVTPQNERIYLIVKTTVQLSHPAAMELVLRK

SEQ ID NO: 30541 - protein, 70 aa, Homo sapiens
  ENSP00000425453
MSDTKVKVAVRVRPMNRRELELNTKCVVEMEGNQTVLHPPPSNTKQGERLVTVAHISNSSTLGGQGKRIT

SEQ ID NO: 30542 - protein, 1826 aa, Homo sapiens
  ENSP00000427900
MGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKRGSLLSEPAIQVRRKGKGKQIWSLEKLDNRLLDMRDLYQEWKECEEDNPVIRSYFKRADPFYDEQENHSLIGVANVFLESLFYDVKLQYAVPIINQKGEVAGRLHVEVMRLSGDVGERIAGGDEVAEVSFEKETQENKLVCMVKILQATGLPQHLSHFVFCKYSFWDQQEPVIVAPEVDTSSSSVSKEPHCMVVFDHCNEFSVNITEDFIEHLSEGALAIEVYGHKINDPRKNPALWDLGIIQAKTRSLRDRWSEVTRKLEFWVQILEQNENGEYCPVEVISAKDVPTGGIFQLRQGQSRRVQVEVKSVQESGTLPLMEECILSVGIGCVKVRPLRAPRTHETFHEEEEDMDSYQDRDLERLRRKWLNALTKRQEYLDQQLQKLVSKRDKTEDDADREAQLLEMRLTLTEERNAVMVPSAGSGIPGAPAEWTPVPGMETHIPVIFLDLNADDFSSQDNLDDPEAGGWDATLTGEEEEEFFELQIVKQHDGEVKAEASWDSAVHGCPQLSRGTPVDERLFLIVRVTVQLSHPADMQLVLRKRICVNVHGRQGFAQSLLKKMSHRSSIPGCGVTFEIVSNIPEDAQGVEEREALARMAANVENPASADSEAYIEKYLRSVLAVENLLTLDRLRQEVAVKEQLTGKGKLSRRSISSPNVNRLSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQPVPRIMVQSASPDIRVTRMEEAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 30543 - protein, 418 aa, Homo sapiens
  ENSP00000429106
LSGSRQDLIPSYSLGSNKGRWESQQDVSQTTVSRGIAPAPALSVSPQNNHSPDPGLSNLAASYLNPVKSFVPQMPKLLKSLFPVRDEKRGKRPSPLAHQAQPEMGPDVLVQTMGAPALKICDKPAKVPSPPPVIAVTAVTPAPEAQDGPPSPLSEASSGYFSHSVSTATLSDALGPGLDAAAPPGSMPTAPEAEPEAPISHPPPPTAVPAEEPPGPQQLVSPGRERPDLEAPAPGSPFRVRRVRASELRSFSRMLAGDPGCSPGAEGNAPAPGAGGQALASDSEEADEVPEWLREGEFVTVGAHKTGVVRYVGPADFQEGTWVGVELDLPSGKNDGSIGGKQYFRCNPGYGLLVRPSRVRRATGPVRRRSTGLRLGAPEARRSATLSGSATNLASLTAALAKADRSHKNPENRKSWAS

SEQ ID NO: 30544 - protein, 61 aa, Homo sapiens
  ENSP00000429027
MGDSKVKVAVRIRPMNRRETDLHTKCVVDVDANKVILNPVNTNLSKGDARLWKILYHDGHS

SEQ ID NO: 30545 - protein, 743 aa, Homo sapiens
  ENSP00000429201
MGDSKVKVAVRIRPMNRRETDLHTKCVVDVDANKVILNPVNTNLSKGDARGQPKVFAYDHCFWSMDESVKEKYAGQDIVFKCLGENILQNAFDGYNACIFAYGQTGSGKSYTMMGTADQPGLIPRLCSGLFERTQKEENEEQSFKVEVSYMEIYNEKVRDLLDPKGSRQTLKVREHSVLGPYVDGLSKLAVTSYKDIESLMSEGNKSRTVAATNMNEESSRSHAVFKITLTHTLYDVKSGTSGEKVGKLSLVDLAGSERATKTGAAGDRLKEGSNINKSLTTLGLVISALADQSAGKNKNKFVPYRDSVLTWLLKDSLGGNSKTAMVATVSPAADNYDETLSTLRYADRAKHIVNHAVVNEDPNARIIRDLREEVEKLREQLTKAEAMKSPELKDRLEESEKLIQEMTVTWEEKLRKTEEIAQERQKQLESLGISLQSSGIKVGDDKCFLVNLNADPALNELLVYYLKEHTLIGSANSQDIQLCGMGILPEHCIIDITSEGQVMLTPQKNTRTFVNGSSVSSPIQLHHGDRILWGNNHFFRLNLPKKKKKAEREDEDQDPSMKNENSSEQLDVDGDSSSEVSSEVNFNYEYAQMEVTMKALGSNDPMQSILNSLEQQHEEEKRSALERQRLMYEHELEQLRRRLSPEKQNCRSMDRFSFHSPSAQQRLRQWAEEREATLNNSLMRLREQIVKANLLVREANYIAEELDKRTEYKVTLQIPASSLDANRKVRLPFLEKNKDLIG

SEQ ID NO: 30546 - protein, 53 aa, Homo sapiens
  ENSP00000431006
MGDSKVKVAVRIRPMNRRDLTVRSQLIQYGQIPLSSGFKKLSWTSGPEEVKRD

SEQ ID NO: 30547 - protein, 613 aa, Homo sapiens
  ENSP00000449134
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIMQLLMKGNRQRTQEPTAANQTSSRSHAVLQVTVRQRSRVKNILQEVRQGRLFMIDLAGSERASQTQNRGQRMKEGAHINRSLLALGNCINALSDKGSNKYINYRDSKLTRLLKDSLGGNSRTVMIAHISPASSAFEESRNTLTYAGRAKNIKTRVKQNLLNVSYHIAQYTSIIADLRGEIQRLKRKIDEQTGRGQARGRQDRGDIRHIQAEVQLHSGQGEKAGMGQLREQLASAFQEQMDVRRRLLELENRAMEVQIDTSRHLLTIAGWKHEKSRRALKWREEQRKECYAKDDSEKDSDTGDDQPDILEPPEVAAARESIAALVDEQKQLRKQKLALEQRCRELRARGRRLEETLPRRIGSEEQREVLSLLCRVHELEVENTEMQSHALLRDGALRHRHEAVRRLEQHRSLCDEIIQGQRQIIDDYNLAVPQRLEELYEVYLRELEEGSLEQATIMDQVA

SEQ ID NO: 30548 - protein, 998 aa, Homo sapiens
  ENSP00000374566
MKDSGDSKDQQLMVALRVRPISVAELEEGATLIAHKVDEQMVVLMDPMEDPDDILRAHRSREKSYLFDVAFDFTATQEMVYQATTKSLIEGVISGYNATVFAYGPTGCGKTYTMLGTDQEPGIYVQTLNDLFRAIEETSNDMEYEVSMSYLEIYNEMIRDLLNPSLGYLELREDSKGVIQVAGITEVSTINAKEIMQLLMKGNRQRTQEPTAANQTSSRSHAVLQVTVRQRSRVKNILQEVRQGRLFMIDLAGSERASQTQNRGQRMKEGAHINRSLLALGNCINALSDKGSNKYINYRDSKLTRLLKDSLGGNSRTVMIAHISPASSAFEESRNTLTYAGRAKNIKTRVKQNLLNVSYHIAQYTSIIADLRGEIQRLKRKIDEQTGRGQARGRQDRGDIRHIQAEVQLHSGQGEKAGMGQLREQLASAFQEQMDVRRRLLELENRAMEVQIDTSRHLLTIAGWKHEKSRRALKWREEQRKECYAKDDSEKDSDTGDDQPDILEPPEVAAARESIAALVDEQKQLRKQKLALEQRCRELRARGRRLEETLPRRIGSEEQREVLSLLCRVHELEVENTEMQSHALLRDGALRHRHEAVRRLEQHRSLCDEIIQGQRQIIDDYNLAVPQRLEELYEVYLRELEEGSLEQATIMDQVASRALQDSSLPKITPAGTSLTPDSDLESVKTLSSDAQHLQNSALPPLSTESEGHHVFKAGTGAWQAKSSSVPTPPPIQLGSLVTQEAPAQDSLGSWINSSPDSSENLSEIPLSHKERKEILTGTKCIWVKAARRRSRALGTEGRHLLAPATERSSLSLHSLSEGDDARPPGPLACKRPPSPTLQHAASEDNLSSSTGEAPSRAVGHHGDGPRPWLRGQKKSLGKKREESLEAKRRKRRSRSFEVTGQGLSHPKTHLLGPHQAERISDHRMPVCRHPAPGIRHLGKVTLPLAKVKLPPSQNTGPGDSSPLAVPPNPGGGSRRATRGPRLPHGTSTHGKDGCSRHN

SEQ ID NO: 30549 - protein, 613 aa, Homo sapiens; identical to SEQ ID NO: 30547
  ENSP00000449134

SEQ ID NO: 30550 - protein, 998 aa, Homo sapiens; identical to SEQ ID NO: 30548
  ENSP00000374566

SEQ ID NO: 30551 - protein, 1624 aa, Homo sapiens
  ENSP00000328494
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 30552 - protein, 1623 aa, Homo sapiens
  ENSP00000433808
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 30553 - protein, 1610 aa, Homo sapiens
  ENSP00000353724
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDLTVKFWSVRRLPHSGPP

SEQ ID NO: 30554 - protein, 1637 aa, Homo sapiens
  ENSP00000411831
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKSDDSDSSLSEVLRGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 30555 - protein, 2108 aa, Homo sapiens
  ENSP00000385545
MNSVAGNKERLAVSTRGKKYGVNEVCSPTKPAAPFSPESWYRKAYEESRAGSRPTPEGAGSALGSSGTPSPGSGTSSPSSFTGSPGPASPGIGTSSPGSLGGSPGFGTGSPGSGSGGGSSPGSDRGVWCENCNARLVELKRQALRLLLPGPFPGKDPAFSAVIHDKLQVPNTIRKAWNDRDNRCDICATHLNQLKQEAIQMVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQISQLMTESSREGLTEAVLNRYNADKPSACSVPASQGSCVASETSTGTSVAASFFARAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 30556 - protein, 1727 aa, Homo sapiens
  ENSP00000355475
MMMDWKAVAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 30557 - protein, 1954 aa, Homo sapiens
  ENSP00000486478
  MOD_RES (1)..(1): Any amino acid
XDPAFSAVIHDKLQVPNTIRKAWNDRDNRCDICATHLNQLKQEAIQMVLTLEQAAGSEHYDASPCSPPPLSNIPTLVGSRHVGGLQQPRDWAFVPAPCATSNYTGFANKHGSKPSSLGVSNGAEKKSGSPTHQAKVSLQMATSPSNGNILNSVAIQAHQYLDGTWSLSRTNGVTLYPYQISQLMTESSREGLTEAVLNRYNADKPSACSVPASQGSCVASETSTGTSVAASFFARAAQKLNLSSKKKKHRPSTSSAAEPPLFATSFSGILQTSPPPAPPCLLRAVNKVKDTPGLGKVKVMLRICSTLARDTSESSSFLKVDPRKKQITLYDPLTCGGQNAFQKRGNQVPPKMFAFDAVFPQDASQAEVCAGTVAEVIQSVVNGADGCVFCFGHAKLGKSYTMIGKDDSMQNLGIIPCAISWLFKLINERKEKTGARFSVRVSAVEVWGKEENLRDLLSEVATGSLQDGQSPGVYLCEDPICGTQLQNQSELRAPTAEKAAFFLDAAIASRRSHQQDCDEDDHRNSHVFFTLHIYQYRMEKSGKGGMSGGRSRLHLIDLGSCVKALSKNREGGSGLCLSLSALGNVILALVNGSKHIPYKESKLAMLLRESLGNMNCRTTMIAHISAAVGSYAETLSTIQIASRVLRMKKKKTKYTSSSSGGESSCEEGRMRRPTQLRPFHTRATVDPDFPIAHLSSDPDYSSSSEQSCDTVIYIGPNGTALSDKELTDNEGPPDFVPIVPALQKTRGDSRPAEAGEAAAGKSERDCLKCNTFAELQERLDCIDGSEEPSSFPFEELPAQFGPEQASRGPRLSQAAGASPLSESDKEDNGSEGQLTNREGPELPASKMQRSHSPVPAAAPAHSPSPASPRSVPGSSSQHSASPLVQSPSLQSSRESLNSCGFVEGKPRPMGSPRLGIASLSKTSEYKPPSSPSQRCKVYTQKGVLPSPAPLPPSSKDSGVASRESLLQPEVRTPPVGMSPQVLKKSMSAGSEGFPETPVDDEQQAATPSESKKEILSTTMVTVQQPLELNGEDELVFTLVEELTISGVLDSGRPTSIISFNSDCSARALASGSRPVSIISSISEDLECYSSTAPVSEVSITQFLPLPKMSLDEKAQDAGSRRSSISSWLSEMSAGSEGEQSCHSFIAQTCFGHGEAMAEPVASEFVSSLQNTAVVCREKPKASPDNLLILSEMGDDSFNKAAPIKGCKISTVSKAMVTISNTANLSSCEGYIPMKTNITVYPCIAMSPRNIQEPEAPTATPKAGPTLAQSRESKENSAKKEMKFEDPWLKREEEVKKETAHPNEEGMMRCETATGPSNAETRAEQEQDGKPSPGDRLSSSSGEVSASPVTDNFRRVVDGCEMALPGLATQSPVHPNKSVKSSSLPRAFQKASRQEEPDSLSYYCAAETNGVGAASGTPPSKATLEGKVASPKHCVLARPKGTPPLPPVRKSSLDQKNRASPQHSASGSGTSSPLNQPAAFPAGLPDEPSGKTKDASSSSKLFSAKLEQLASRSNSLGRATVSHYECLSLERAESLSSVSSRLHAGKDGTMPRAGRSLGRSAGTSPPSSGASPKAGQSKISAVSRLLLASPRARGPSASTTKTLSFSTKSLPQAVGQGSSSPPGGKHTPWSTQSLSRNRSSGLASKLPLRAVSGRISELLQGGAGARGLQLRAGPEAEARGGALAEDEPAAAHLLPSPYSKITPPRRPHRCSSGHGSDNSSVLSGELPPAMGKTALFYHSGGSSGYESVMRDSEATGSASSAQDSTSENSSSVGGRCRSLKTPKKRSNPGSQRRRLIPALSLDTSSPVRKPPNSTGVRWVDGPLRSSPRGLGEPFEIKVYEIDDVERLQRRRGGASKEAMCFNAKLKILEHRQQRIAEVRAKYEWLMKELEATKQYLMLDPNKWLSEFDLEQVWELDSLEYLEALECVTERLESRVNFCKAHLMMITCFDITSRRR

SEQ ID NO: 30558 - protein, 747 aa, Homo sapiens
  ENSP00000364864
MSKLKSSESVRVVVRCRPMNGKEKAASYDKVVDVDVKLGQVSVKNPKGTAHEMPKTFTFDAVYDWNAKQFELYDETFRPLVDSVLQGFNGTIFAYGQTGTGKTYTMEGIRGDPEKRGVIPNSFDHIFTHISRSQNQQYLVRASYLEIYQEEIRDLLSKDQTKRLELKERPDTGVYVKDLSSFVTKSVKEIEHVMNVGNQNRSVGATNMNEHSSRSHAIFVITIECSEVGLDGENHIRVGKLNLVDLAGSERQAKTGAQGERLKEATKINLSLSALGNVISALVDGKSTHIPYRDSKLTRLLQDSLGGNAKTVMVANVGPASYNVEETLTTLRYANRAKNIKNKPRVNEDPKDALLREFQEEIARLKAQLEKRSIGRRKRREKRREGGGSGGGGEEEEEEGEEGEEEGDDKDDYWREQQEKLEIEKRAIVEDHSLVAEEKMRLLKEKEKKMEDLRREKDAAEMLGAKIKAMESKLLVGGKNIVDHTNEQQKILEQKRQEIAEQKRREREIQQQMESRDEETLELKETYSSLQQEVDIKTKKLKKLFSKLQAVKAEIHDLQEEHIKERQELEQTQNELTRELKLKHLIIENFIPLEEKSKIMNRAFFDEEEDHWKLHPITRLENQQMMKRPVSAVGYKRPLSQHARMSMMIRPEARYRAENIVLLELDMPSRTTRDYEGPAIAPKVQAALDAALQDEDEIQVDASSFESTANKKSKARPKSGRKSGSSSSSSGTPASQLYPQSRGLVPK

SEQ ID NO: 30559 - protein, 689 aa, Homo sapiens
  ENSP00000409417
  MOD_RES (1)..(1): Any amino acid
XGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 30560 - protein, 814 aa, Homo sapiens
  ENSP00000287152
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 30561 - protein, 248 aa, Homo sapiens
  ENSP00000377889
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSDVNARKILPSPCPSPHSQKQSSTSTPLEDSIPKRPVSSIPLTGDSQTDSDIIAFIKARQSILQKQCLGSN

SEQ ID NO: 30562 - protein, 265 aa, Homo sapiens
  ENSP00000229913
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 30563 - protein, 161 aa, Homo sapiens
  ENSP00000404856
TPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLKAPSSSDGVLFCRNQ

SEQ ID NO: 30564 - protein, 293 aa, Homo sapiens
  ENSP00000441435
MREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHEWSQLLSNKSSGGWEVQDQGTGRFDVCDVNARKILPSPCPSPHSQKQSSTSTPLEDSIPKRPVSSIPLTGDSQTDSDIIAFIKARQSILQKQYLQLLCSLFPKSAVSSAQASTNRKGLSDVLVTR

SEQ ID NO: 30565 - protein, 593 aa, Homo sapiens
  ENSP00000353202
MGQGLKAWPRYRVVGSADAGQYNLEITDAELSDDASYECQATEAALRSRRAKLTVLNPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 30566 - protein, 757 aa, Homo sapiens
  ENSP00000352138
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 30567 - protein, 571 aa, Homo sapiens
  ENSP00000357154
MNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 30568 - protein, 657 aa, Homo sapiens
  ENSP00000357155
MLSLLVWILTLSDTFSQVPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 30569 - protein, 972 aa, Homo sapiens
  ENSP00000390987
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 30570 - protein, 976 aa, Homo sapiens [sequence omitted]

SEQ ID NO: 30571 - protein, 273 aa, Homo sapiens
  ENSP00000228280
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 30572 - protein, 245 aa, Homo sapiens
  ENSP00000054216
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 30573 - protein, 56 aa, Homo sapiens
  ENSP00000474021
MALPALFSLIIGFAFGALYWKKRQPSLTRAVENIQINEEDNEISMLQEKEREFQEV

SEQ ID NO: 30574 - protein, 24 aa, Homo sapiens
  ENSP00000475042
MITLKYVPGMDVLPSHCWISEMVV

SEQ ID NO: 30575 - protein, 273 aa, Homo sapiens; identical to SEQ ID NO: 30571
  ENSP00000228280

SEQ ID NO: 30576 - protein, 245 aa, Homo sapiens; identical to SEQ ID NO: 30572
  ENSP00000054216

SEQ ID NO: 30577 - protein, 56 aa, Homo sapiens; identical to SEQ ID NO: 30573
  ENSP00000474021

SEQ ID NO: 30578 - protein, 24 aa, Homo sapiens
  ENSP00000475042
MITLKYVPGMDVLPSHCWISEMVV

SEQ ID NO: 30579 - protein, 520 aa, Homo sapiens
  ENSP00000457570
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 30580 - protein, 463 aa, Homo sapiens
  ENSP00000262530
MGKKGKKEKKGRGAEKTAAKMEKKVSKRSRKEETFLYNELYVYNTRKDTWTKVDIPSPPPRRCAHQAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 30581 - protein, 489 aa, Homo sapiens
  ENSP00000325717
MGKKGKKEKKGRGAEKTAAKMEKKVSKRSRKEEEDLEALIAHFQTLDAKRTQTVELPCPPPSPRLNASLSVHPEKDELILFGGEYFNGQKTFLYNELYVYNTRKDTWTKVDIPSPPPRRCAHQAVVVPQGGGQLWVFGGEFASPNGEQFYHYKDLWVLHLATKTWEQVKDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGSPAPGPCPRSNAMLAVKHGVLYVYGGMFEAGDRQVTLSDLHCLDLHRMEAWKALVEMDPETQEWLEETDSEEDSEEVEGAEGGVDDEDSGEESGAED

SEQ ID NO: 30582 - protein, 520 aa, Homo sapiens; identical to SEQ ID NO: 30579
  ENSP00000270583

SEQ ID NO: 30583 - protein, 99 aa, Homo sapiens
  ENSP00000455824
MGKKGKKEKKGRGAEKTAAKMEKKVSKRSRKEEEDLEALIAHFQTLDAKRTQTVELPCPPPSPRLFCITSSMSTIPERTPGPKLTSPVHLRGAVLTRRW

SEQ ID NO: 30584 - protein, 334 aa, Homo sapiens
  ENSP00000455780
MGKKGKKEKKGRGAEKTAAKMEKKVSKRSRKEEAVVVPQGGGQLWVFGGEFASPNGEQFYHYKDLWVLHLATKTWEQVKSTGGPSGRSGHRMVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKGPKSEKKKRRRGRKEEPEGGSRPACGGAGTQGPVQLVKEVVAEDGTVVTIKQVLTAPGSAGQPRSEDEDSLEEAGS

SEQ ID NO: 30585 - protein, 105 aa, Homo sapiens
  ENSP00000455666
MGKKGKKEKKGRGAEKTAAKMEKKVSKRSRKEEEDLEALIAHFQTLDAKRTQTVELPCPPPSPRLNASLSVHPEKDELILFGERTPGPKLTSPVHLRGAVLTRRW

SEQ ID NO: 30586 - protein, 86 aa, Homo sapiens
  ENSP00000455214
MGKKGKKEKKGRGAEKTAAKMEKKVSKRSRKEEEDLEALIAHFQTLDAKRTQTVELPCPPPSPRLNASLSVHPEKDELILFGDFFV

SEQ ID NO: 30587 - protein, 173 aa, Homo sapiens
  ENSP00000457990
MGKKGKKEKKGRGAEKTAAKMEKKVSKRSRKEEPGVCRRIRPDLGVECSAAAAHGFPNRGQFYGLPCARHSSLGFTPHEQEDLEALIAHFQTLDAKRTQTVELPCPPPSPRLNASLSVHPEKDELILFGGEYFNGQKTFLYNELYVYNTRKDTWTKVDIPSPPPRRCAHQAVV

SEQ ID NO: 30588 - protein, 38 aa, Homo sapiens
  ENSP00000457098
MGKKGKKEKKGRGAEKTAAKMEKKVSKRSRKEETWKRS

SEQ ID NO: 30589 - protein, 44 aa, Homo sapiens
  ENSP00000454681
MGKKGKKEKKGRGAEKTAAKMEKKVSKRSRKEERANNHHSSPEQ

SEQ ID NO: 30590 - protein, 44 aa, Homo sapiens; identical to SEQ ID NO: 30589
  ENSP00000457857

SEQ ID NO: 30591 - protein, 258 aa, Homo sapiens
  ENSP00000482433
MVAWKRQLILFGGFHESTRDYIYYNDVYAFNLDTFTWSKLSPSGTGPTPRSGCQMSVTPQGGIVVYGGYSKQRVKKDVDKGTRHSDMFLLKPEDGREDKWVWTRMNPSGVKPTPRSGFSVAMAPNHQTLFFGGVCDEEEEESLSGEFFNDLYFYDATRNRWFEGQLKKLRSGWRRRTRKRTVRRLRAPRVGSTTKTAERRAVRRTESPCQGRLASAVPTSAQDPAVLSEALGASVRPDAQERAEGGWPRPGCELSPMV

SEQ ID NO: 30592 - protein, 291 aa, Homo sapiens
  ENSP00000392909
MPGKLLPEKCALMWLHLGTRAPQRPKRESRGFPGWGCRTGQALPCRARPPAPAPSHPSSSLSLTPGPGSPRQTGPPCQTVAALYGLGAWQSHCGGGVGCHGQGRQPLGCQGWWSTLNPYLLESPGLFHTRSCGKLWDPKAVLISGVTSSHSSLGSPGTRPGVSLCKELPGCWAELCCRPRKMTKKDRAEPHLPLLGGPEGARAQQSPILHSLGSKRLPRCGWQLLTSSGGAAGGLCPMGHRREKDGGRVCTLGRTGGRHRPEQVAWAHEKGVSETGCLSQMPGVDEADEWQ

SEQ ID NO: 30593 - protein, 604 aa, Homo sapiens
  ENSP00000360949
MGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 30594 - protein, 604 aa, Homo sapiens; identical to SEQ ID NO: 30593
  ENSP00000360943

SEQ ID NO: 30595 - protein, 604 aa, Homo sapiens; identical to SEQ ID NO: 30593
  ENSP00000360945

SEQ ID NO: 30596 - protein, 655 aa, Homo sapiens
  ENSP00000262820
MPLKWKTSSPAIWKFPVPVLKTSRSTPLSPAYISLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 30597 - protein, 658 aa, Homo sapiens
  ENSP00000419803
MMRVQTLREKWAYWRRRQLSLKQADFKDIFKKSTSGSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 30598 - protein, 94 aa, Homo sapiens
  ENSP00000393807
MDHLHRGELVAAILRNRRRRQLSLKQADFKDIFKKSTSGSLVEEEDQHMKLSLGGSEMGLSSHLQSSKAGPTRIFTSNTHSSVVLQGFDQLRLE

SEQ ID NO: 30599 - protein, 613 aa, Homo sapiens
  ENSP00000440707
MKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 30600 - protein, 639 aa, Homo sapiens
  ENSP00000441029
MDHLHRGELVAAILRNRSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 30601 - protein, 639 aa, Homo sapiens; identical to SEQ ID NO: 30600
  ENSP00000444450

SEQ ID NO: 30602 - protein, 604 aa, Homo sapiens
  ENSP00000332791
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSKILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 30603 - protein, 634 aa, Homo sapiens
  ENSP00000331682
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 30604 - protein, 225 aa, Homo sapiens
  ENSP00000400095
MFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVG

SEQ ID NO: 30605 - protein, 295 aa, Homo sapiens
  ENSP00000403999
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDP

SEQ ID NO: 30606 - protein, 235 aa, Homo sapiens
  ENSP00000398616
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLH

SEQ ID NO: 30607 - protein, 251 aa, Homo sapiens
  ENSP00000397882
MGLGSSCHLSLPKRAEALLCSRKATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGA

SEQ ID NO: 30608 - protein, 158 aa, Homo sapiens
  ENSP00000409092
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQMLFTSPGLNGCHSLCRSQKLSISAVIS

SEQ ID NO: 30609 - protein, 107 aa, Homo sapiens
  ENSP00000402746
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYF

SEQ ID NO: 30610 - protein, 709 aa, Homo sapiens
  ENSP00000261425
MSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 30611 - protein, 568 aa, Homo sapiens
  ENSP00000423080
MEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 30612 - protein, 755 aa, Homo sapiens
  ENSP00000423897
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 30613 - protein, 757 aa, Homo sapiens
  ENSP00000371355
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVWHSCFIITLTLFLLKQFLW

SEQ ID NO: 30614 - protein, 694 aa, Homo sapiens
  ENSP00000261426
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 30615 - protein, 36 aa, Homo sapiens
  ENSP00000426949
  MOD_RES (1)..(1): Any amino acid
XAEDCGGAHWLDRPEVDDGTSEEENESDSSSCSSPD

SEQ ID NO: 30616 - protein, 282 aa, Homo sapiens
  ENSP00000425512
  MOD_RES (1)..(1): Any amino acid
XRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVFSHTFEDSKDHLVAIKQTIWRQNSLSEEFRSH

SEQ ID NO: 30617 - protein, 244 aa, Homo sapiens
  ENSP00000366047
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 30618 - protein, 244 aa, Homo sapiens; identical to SEQ ID NO: 30617
  ENSP00000309148

SEQ ID NO: 30619 - protein, 40 aa, Homo sapiens
  ENSP00000469630
MKKLMVVLSLIAAGIFRSSWGSITFGKGRVPRSRVLLSGL

SEQ ID NO: 30620 - protein, 244 aa, Homo sapiens; identical to SEQ ID NO: 30617
  ENSP00000470482

SEQ ID NO: 30621 - protein, 40 aa, Homo sapiens; identical to SEQ ID NO: 30619
  ENSP00000471948

SEQ ID NO: 30622 - protein, 69 aa, Homo sapiens
  ENSP00000469702
MADPATRHLTPTKLPSTPRATCSVVGSLSIHCGSSQLPTAKNRIFRSSWGSITFGKGRVPRSRVLLSGL

SEQ ID NO: 30623 - protein, 137 aa, Homo sapiens
  ENSP00000375684
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 30624 - protein, 1749 aa, Homo sapiens
  ENSP00000304437
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 30625 - protein, 1141 aa, Homo sapiens
  ENSP00000357560
MRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQASGLRAPLCPVRQ

SEQ ID NO: 30626 - protein, 458 aa, Homo sapiens
  ENSP00000219837
MITKTHKVDLGLPEKKKKKKVVKEPETRYSVLNNDDYFADVSPLRATSPSKSVAHGQAPEMPLVKKKKKKKKGVSTLCEEHVEPETTLPARRTEKSPSLRKQVFGHLEFLSGEKKNKKSPLAMSHASGVKTSPDPRQGEEETRVGKKLKKHKKEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEETDTDLEVVLEKKGNMDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 30627 - protein, 137 aa, Homo sapiens
  ENSP00000455015
MDEAHIDQVRRKALQEEIDRESGKTEASETRKWTGTQFGQWDTAGFENEDQKLKFLRLMGGFKNLSPSFSRPASTIARPNMALGKKAADSLQQNLQRDYDRAMSWKYSRGAGLGFSTAPNKIFYIDRNASKSVKLED

SEQ ID NO: 30628 - protein, 199 aa, Homo sapiens
  ENSP00000455369
  MOD_RES (1)..(1): Any amino acid
XEKKGAQDPTAFSVQDPWFCEAREARDVGDTCSVGKKDEEQAALGQKRKRKSPREHNGKVKKKKKIHQEGDALPGHSKPSRSMESSPRKGSKKKPVKVEAPEYIPISDDPKASAKKKMKSKKKVEQPVIEEPALKRKKKKKRKESGVAGDPWKEVRRKALQEEIDRESGKTEASETRKWTGTQFGQWDTAGFENEDQKL

SEQ ID NO: 30629 - protein, 79 aa, Homo sapiens
  ENSP00000454329
MITKTHKVDLGLPEKKKKKKVVKEPETRYSVLNNDDYFADVSPLRATSPSKSVAHGQAPEMPLVKKKKKKKKGVSTLCE

SEQ ID NO: 30630 - protein, 1134 aa, Homo sapiens
  ENSP00000397992
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 30631 - protein, 2209 aa, Homo sapiens
  ENSP00000328236
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKLQGQIKSSFISTENYHTLGCLSLVAGDLASEVPVIIGGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 30632 - protein, 104 aa, Homo sapiens
  ENSP00000397140
MDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKIT

SEQ ID NO: 30633 - protein, 130 aa, Homo sapiens
  ENSP00000408760
MLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 30634 - protein, 208 aa, Homo sapiens
  ENSP00000439119
KVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVNSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIA

SEQ ID NO: 30635 - protein, 130 aa, Homo sapiens; identical to SEQ ID NO: 30633
  ENSP00000437344

SEQ ID NO: 30636 - protein, 58 aa, Homo sapiens
  ENSP00000377613
MELSQLLNEIRANYEKILTRNQIETVLSTRIQVMISYRQAPSRIRRQSMSTQFLSRPL

SEQ ID NO: 30637 - protein, 295 aa, Homo sapiens
  ENSP00000377616
MELSQLLNEIRANYEKILTRNQIETVLSTRIQLEEDISKKMDKDEEALKAAQAELKEARRQWHHLQVEIESLHAVERGLENSLHASEQHYQMQLQDLETVIEGLEKELQEVRRGIEKQLQEHEMLLNTKMRLEQEIATYRHLLEKEEIRYYGCIQGGKKDKKPTTSRVGFVLPSAIINEISFTTKVPQKYENENVETVTKQAILNGSIVKESTEAHGTIQTEKVDEVIKEWEGSFFKDNPRLRKKSVSLRFDLHLAATDEGCLETKQDNLPDIEVRLIMRRSCSIPSIKPPSTAN

SEQ ID NO: 30638 - protein, 58 aa, Homo sapiens; identical to SEQ ID NO: 30636
  ENSP00000463865

SEQ ID NO: 30639 - protein, 58 aa, Homo sapiens; identical to SEQ ID NO: 30636
  ENSP00000464647

SEQ ID NO: 30640 - protein, 525 aa, Homo sapiens
  ENSP00000264651
MSCSSRASSSRAGGSSSARVSAGGSSFSSGSRCGLGGSSAQGFRGGASSCSLSGGSSGAFGGSFGGGFGSCSVGGGFGGASGSGTGFGGGSSFGGVSGFGRGSGFCGSSRFSSGATGGFYSYGGGMGGGVGDGGLFSGGEKQTMQNLNDRLANYLDKVRALEEANTDLENKIKEWYDKYGPGSGDGGSGRDYSKYYSIIEDLRNQIIAATVENAGIILHIDNARLAADDFRLKYENELCLRQSVEADINGLRKVLDDLTMTRSDLEMQIESFTEELAYLRKNHEEEMKNMQGSSGGEVTVEMNAAPGTDLTKLLNDMRAQYEELAEQNRREAEERFNKQSASLQAQISTDAGAATSAKNEITELKRTLQALEIELQSQLAMKSSLEGTLADTEAGYVAQLSEIQTQISALEEEICQIWGETKCQNAEYKQLLDIKTRLEVEIETYRRLLDGEGGGSSFAEFGGRNSGSVNMGSRDLVSGDSRSGSCSGQGRDSSKTRVTKTIVEELVDGKVVSSQVSSISEVKVK

SEQ ID NO: 30641 - protein, 146 aa, Homo sapiens
  ENSP00000354001
MCHTSCSSGCQPACCAPSPCQPACCVPSSCQASCCVPVGCQSSVCVPVSFKPAVCLPVSCQSSVCVPMSFKSAVCVPVSCQSSVCVPVSCRPIVCAAPSCQSSLCVPVSCRPVVYAAPSCQSSGCCQPSCTSVLCRPISYSISSCC

SEQ ID NO: 30642 - protein, 950 aa, Homo sapiens [sequence omitted]

SEQ ID NO: 30643 - protein, 921 aa, Homo sapiens
  ENSP00000389715
MIDLSISNLEGLRTKCATSNDLTQKEIRTLESKLVKYFSRQLSCKKKVALQERNAELDGFPQLRHWFRIVDVRKEVLEEISPGQLSLEDLLEMTDEQVCETVEKYGANREECARLNASLSCLRNVHMSGGNLSKQDWTIQWPTTETGKENNPVCPPEPTPWIRTHLSQSPRVPSKCVQHYCHTSPTPGAPVYTHVDRLTVDAYPGLCPPPPLESGHRSLPPSPRQRHAVRTPPRTPNIVTTVTPPGTPPMRKKNKLKPPGTPPPSSRKLIHLIPGFTALHRSKSHEFQLGHRVDEAHTPKAKKKSKPLNLKIHSSVGSCENIPSQQRSPLLSERSLRSFFVGHAPFLPSTPPVHTEANFSANTLSVPRWSPQIPRRDLGNSIKHRFSTKYWMSQTCTVCGKGMLFGLKCKNCKLKCHNKCTKEAPPCHLLIIHRGDPARLVRTESVPCDINNPLRKPPRYSDLHISQTLPKTNKINKDHIPVPYQPDSSSNPSSTTSSTPSSPAPPLPPSATPPSPLHPSPQCTRQQKNFNLPASHYYKYKQQFIFPDVVPVPETPTRAPQVILHPVTSNPILEGNPLLQIEVEPTSENEEVHDEAEESEDDFEEMNLSLLSARSFPRKASQTSIFLQEWDIPFEQLEIGELIGKGRFGQVYHGRWHGEVAIRLIDIERDNEDQLKAFKREVMAYRQTRHENVVLFMGACMSPPHLAIITSLCKGRTLYSVVRDAKIVLDVNKTRQIAQEIVKGMGYLHAKGILHKDLKSKNVFYDNGKVVITDFGLFSISGVLQAGRREDKLRIQNGWLCHLAPEIIRQLSPDTEEDKLPFSKHSDVFALGTIWYELHAREWPFKTQPAEAIIWQMGTGMKPNLSQIGMGKEISDILLFCWAFEQEERPTFTKLMDMLEKLPKRNRRLSHPGHFWKSAEL

SEQ ID NO: 30644 - protein, 1257 aa, Homo sapiens
  ENSP00000359077
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 30645 - protein, 1248 aa, Homo sapiens
  ENSP00000359072
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 30646 - protein, 153 aa, Homo sapiens
  ENSP00000359075
EEKGGASLSPQYVSYNQSSYTQWDLQPDTDYEIHLFKERMFRHQMAVKTNGTVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 30647 - protein, 1253 aa, Homo sapiens
  ENSP00000355380
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 30648 - protein, 190 aa, Homo sapiens
  ENSP00000397792
  MOD_RES (1)..(1): Any amino acid
XDPSLQPSITWRGDGRDLQELGDSDKYFIEDGRLVIHSLDYSDQGNYSCVASTELDVVESRAQLLVVEYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVS

SEQ ID NO: 30649 - protein, 150 aa, Homo sapiens
  ENSP00000402407
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEE

SEQ ID NO: 30650 - protein, 128 aa, Homo sapiens
  ENSP00000384902
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAE

SEQ ID NO: 30651 - protein, 90 aa, Homo sapiens
  ENSP00000392524
MVVALRYVWPLLLCSPCLLIQIPEELMEPPVITEQSPRRLVVFPTDDISLKCEASGKPEVQFRWTRDGVHFKPKEELGVTVYQSPHSGSF

SEQ ID NO: 30652 - protein, 83 aa, Homo sapiens
  ENSP00000396079
MVVALRYVWPLLLCSPCLLIQIPEEYEGHHVMEPPVITEQSPRRLVVFPTDDISLKCEASGKPEVQFRWTRDGVHFKPKEELG

SEQ ID NO: 30653 - protein, 1248 aa, Homo sapiens; identical to SEQ ID NO: 30645
  ENSP00000354712

SEQ ID NO: 30654 - protein, 354 aa, Homo sapiens
  ENSP00000247194
MESALAVPRLPPHDPGTPVLSVVDMHTGGEPLRIVLAGCPEVSGPTLLAKRRYMRQHLDHVRRRLMFEPRGHRDMYGAVLVPSELPDAHLGVLFLHNEGYSSMCGHAVLALGRFALDFGLVPAPPAGTREARVNIHCPCGLVTAFVACEDGRSHGPVRFHSVPAFVLATDLMVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVREAKCGDFKAVIVEVSGQAHYTGTASFIIEDDDPLRDGFLLK

SEQ ID NO: 30655 - protein, 145 aa, Homo sapiens
  ENSP00000431608
MVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVRELL

SEQ ID NO: 30656 - protein, 142 aa, Homo sapiens
  ENSP00000423874
MVDVPGHGKVMVDIAYGGAFYAFVTAEKLGLDICSAKTRDLVDAASAVTEAVKAQFKINHPDSEDLAFLYGTILTDGKDAYTKEPTTNICVFADEQVDRSPTGSGVTARIALQYHKGLLELNQMRAFKSSATGSVFTGKAVR

SEQ ID NO: 30657 - protein, 705 aa, Homo sapiens
  ENSP00000216237
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 30658 - protein, 40 aa, Homo sapiens
  ENSP00000405849
MEKPRSIERWGVAVLPRLVSNSWVQAIHLPQPPKVLGLQM

SEQ ID NO: 30659 - protein, 614 aa, Homo sapiens
  ENSP00000414423
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAGKLPRSL

SEQ ID NO: 30660 - protein, 288 aa, Homo sapiens
  ENSP00000399405
  MOD_RES (1)..(1): Any amino acid
XRPHLQNQWRKRKMTTWSCLVAMIVSGVITAVWAVRAAPIWRSQVKQKMRIGKQGNCRPPRCICSALGLLAPWMAVVLSQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKVGSEPLTDVPPSALPFFCILHATHWS

SEQ ID NO: 30661 - protein, 232 aa, Homo sapiens
  ENSP00000403767
ETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHGIGCCFGMKALKMTPAMTSGATWEQWMSTPLAGVPSTARS

SEQ ID NO: 30662 - protein, 3075 aa, Homo sapiens
  ENSP00000374309
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 30663 - protein, 217 aa, Homo sapiens
  ENSP00000491821
MLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGMSKSTWTPAGCQKGLSWLPMQRTKLLPEPRAFPVGAASFTISQVQSAKEGLGQRELKWGLAVKVPAKAGAGAGAGAVLKIRAGTGRERVPQATQMTRPNP

SEQ ID NO: 30664 - protein, 3122 aa, Homo sapiens
  ENSP00000400365
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 30665 - protein, 3121 aa, Homo sapiens
  ENSP00000480802
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNTVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 30666 - protein, 3118 aa, Homo sapiens
  ENSP00000481744
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNNAVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLRPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 30667 - protein, 3333 aa, Homo sapiens
  ENSP00000324532
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 30668 - protein, 576 aa, Homo sapiens
  ENSP00000468316
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQGPSEKVAIYKPESRPSAETEPASTWILDFPASRTGEINFYCL

SEQ ID NO: 30669 - protein, 3277 aa, Homo sapiens
  ENSP00000382432
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 30670 - protein, 59 aa, Homo sapiens
  ENSP00000467662
  MOD_RES (1)..(1): Any amino acid
XAGQVNIYSCNYRCDAMNSLLSPQRLCQVPGCIAQGKRLILSNVRGCTPTFATHLQNWG

SEQ ID NO: 30671 - protein, 1724 aa, Homo sapiens
  ENSP00000269217
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 30672 - protein, 1668 aa, Homo sapiens
  ENSP00000466557
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 30673 - protein, 1147 aa, Homo sapiens
  ENSP00000464836
  MOD_RES (1)..(1): Any amino acid
XFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRQEGCLRPRVRDQSWKHSETMSLRKLK

SEQ ID NO: 30674 - protein, 94 aa, Homo sapiens
  ENSP00000467473
LVRSASFSRGGQLSFTDLGLPPTDHLQASFGFQTFQPSGILLDHQTWTRNLQVTLEDGYIELSTSDSGGPIFKSPQTYMDGLLHYVSVISDNSG

SEQ ID NO: 30675 - protein, 37 aa, Homo sapiens
  ENSP00000466658
  MOD_RES (1)..(1): Any amino acid
XGWTEGPGGKFAWKLHHQHQSASLPGITSIRETKGAG

SEQ ID NO: 30676 - protein, 134 aa, Homo sapiens
  ENSP00000468315
  MOD_RES (1)..(1): Any amino acid
XFSEEGGHVVLAHSVLLGPEFKLVFSIRPRSLTGILIHIGSQPGKHLCVYLEAGKVTASMDSGAGGTSTSVTPKQSLCDGQWHSVAANLTTLRIPVWKSFFGCLRNIHVNHIPVPVTEALEVQGPVSLNGCPDQ

SEQ ID NO: 30677 - protein, 1823 aa, Homo sapiens
  ENSP00000230538
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 30678 - protein, 1816 aa, Homo sapiens
  ENSP00000429488
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 30679 - protein, 1816 aa, Homo sapiens; identical to SEQ ID NO: 30678
  ENSP00000374114

SEQ ID NO: 30680 - protein, 1816 aa, Homo sapiens; identical to SEQ ID NO: 30678
  ENSP00000416470

SEQ ID NO: 30681 - protein, 188 aa, Homo sapiens
  ENSP00000427837
  MOD_RES (1)..(1): Any amino acid
XKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGKHQRELKSHLLIHWSVR

SEQ ID NO: 30682 - protein, 187 aa, Homo sapiens
  ENSP00000427865
  MOD_RES (1)..(1): Any amino acid
XSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 30683 - protein, 178 aa, Homo sapiens
  ENSP00000357629
  MOD_RES (1)..(1): Any amino acid
XIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 30684 - protein, 331 aa, Homo sapiens
  ENSP00000430336
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQ

SEQ ID NO: 30685 - protein, 106 aa, Homo sapiens
  ENSP00000428583
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTT

SEQ ID NO: 30686 - protein, 129 aa, Homo sapiens
  ENSP00000412136
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVTTDGEDPGFSASALSFILSSQGAREARAPT

SEQ ID NO: 30687 - protein, 87 aa, Homo sapiens
  ENSP00000243219
MALSSAWRSVLPLWLLWSAACSRAASGDDNAFPFDIEGSSAVGRQDPPETSEPRVALGRLPPAAEKCNAGFFHTLSGECVPCDCNGN

SEQ ID NO: 30688 - protein, 81 aa, Homo sapiens
  ENSP00000430415
MALSSAWRSVLPLWLLWSAACSRAASGDDNAFPFDIEGSSAVGRQDPPETSEPRVALGRLPPAAEKCNAGFFHTLSGECVP

SEQ ID NO: 30689 - protein, 120 aa, Homo sapiens
  ENSP00000357627
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 30690 - protein, 120 aa, Homo sapiens; identical to SEQ ID NO: 30689
  ENSP00000398226

SEQ ID NO: 30691 - protein, 120 aa, Homo sapiens; identical to SEQ ID NO: 30689
  ENSP00000408604

SEQ ID NO: 30692 - protein, 1810 aa, Homo sapiens
  ENSP00000377191
MDCPLSAPTPPPPLVRFFRAPLPACVPPTLLPVLPAALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 30693 - protein, 1786 aa, Homo sapiens
  ENSP00000222399
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 30694 - protein, 850 aa, Homo sapiens
  ENSP00000377190
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKRRFLKSIVMHSFRLTQPLWQGSIAAEPMLPS

SEQ ID NO: 30695 - protein, 183 aa, Homo sapiens
  ENSP00000412686
MGLLQLLAFSFLETAGPGASLEWRSLETTPEPQGLSMGSPSSGKRRPPRAPAPRPQRSAGDPRACTHTHSRFPSSQISTRTLTPRMRGLPRARGFTCVALCRARVRAQEPEFSYGCAEGSCYPATGDLLIGRAQKLSVTSTCGLHKPEPYCIVSHLQEDKKCFICNSQDPYHETLNPDSHLIE

SEQ ID NO: 30696 - protein, 91 aa, Homo sapiens
  ENSP00000377189
MGLLQLLAFSFLALCRARVRAQEPEFSYGCAEGSCYPATGDLLIGRAQKLSVTSTCGLHKPEPYCIVSHLQEDKKCFICNSQDPYHETLNP

SEQ ID NO: 30697 - protein, 1798 aa, Homo sapiens
  ENSP00000388325
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 30698 - protein, 1798 aa, Homo sapiens; identical to SEQ ID NO: 30697
  ENSP00000307156

SEQ ID NO: 30699 - protein, 151 aa, Homo sapiens
  ENSP00000444751
MTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPA

SEQ ID NO: 30700 - protein, 236 aa, Homo sapiens
  ENSP00000406360
MDLQGRGVPSIDRLRVLLMLFHTMAQIMAEQEVENLSGLSTNPEKDIFVVRENGTTCLMAEFAAKFIVPYDVWASNYVDESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 30701 - protein, 280 aa, Homo sapiens
  ENSP00000246070
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 30702 - protein, 317 aa, Homo sapiens
  ENSP00000402301
MTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 30703 - protein, 226 aa, Homo sapiens
  ENSP00000428409
MKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 30704 - protein, 152 aa, Homo sapiens
  ENSP00000429868
MKMVAPWTRFYSNSCCLCCHVRTGTILLGVWYLIINAVVLLILLSALADPDQYNFSSSELGGDFEFMDDAKILFNLSADMCIAIAISLLMILICAMATYGAYKQRAAWIIPFFCYQIFDFALNMLVAITVLIYPNSIQEYIRQLPPNFPYRD

SEQ ID NO: 30705 - protein, 317 aa, Homo sapiens; identical to SEQ ID NO: 30702
  ENSP00000482533

SEQ ID NO: 30706 - protein, 491 aa, Homo sapiens
  ENSP00000299213
MAQSGGEARPGPKTAVQIRVAIQEAEDVDELEDEEEGAETRGAGDPARYLSPGWGSASEEEPSRGHSGTTASGGENEREDLEQEWKPPDEELIKKLVDQIEFYFSDENLEKDAFLLKHVRRNKLGYVSVKLLTSFKKVKHLTRDWRTTAHALKYSVVLELNEDHRKVRRTTPVPLFPNENLPSKMLLVYDLYLSPKLWALATPQKNGRVQEKVMEHLLKLFGTFGVISSVRILKPGRELPPDIRRISSRYSQVGTQECAIVEFEEVEAAIKAHEFMITESQGKENMKAVLIGMKPPKKKPAKDKNHDEEPTASIHLNKSLNKRVEELQYMGDESSANSSSDPESNPTSPMAGRRHAATNKLSPSGHQNLFLSPNASPCTSPWSSPLAQRKGVSRKSPLAEEGRLNCSTSPEIFRKCMDYSSDSSVTPSGSPWVRRRRQAEMGTQEKSPGTSPLLSRKMQTADGLPVGVLRLPRGPDNTRGFHGHERSRACV

SEQ ID NO: 30707 - protein, 31 aa, Homo sapiens
  ENSP00000467334
MLLVYDLYLSPKLWALATPQKNGRVQEKVME

SEQ ID NO: 30708 - protein, 93 aa, Homo sapiens
  ENSP00000343869
MAQSGGEARPGPKTAVQIRVAIQEAEDVDELEDEEEGAETRGAGDPARYLSPGWGSASEEEPSRGHRNRSSVNSRTMLASFIVSSAPSTAPST

SEQ ID NO: 30709 - protein, 78 aa, Homo sapiens
  ENSP00000453551
  MOD_RES (1)..(1): Any amino acid
XVDELEDEEEGAETRGAGDPARYLSPGWGSASEEEPSRGHRTAQLPWLESQQVFSLKPFLLPTGIELTPENPWGSSVS

SEQ ID NO: 30710 - protein, 903 aa, Homo sapiens
  ENSP00000265537
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 30711 - protein, 903 aa, Homo sapiens; identical to SEQ ID NO: 30710
  ENSP00000408576

SEQ ID NO: 30712 - protein, 144 aa, Homo sapiens
  ENSP00000406611
MASVWQRLGFYASLLKRQLNGGPDVIKWERRVIPGCTRSIYSATGKWTKEYTLQTRKDVEKWWHQRIKEQASKISEADVINPMGWDAFGLPAENAAVERNLHPQSWTQSNIKHMRKQLDRLGLCFSWDREITTCLPDYYKWTQY

SEQ ID NO: 30713 - protein, 860 aa, Homo sapiens
  ENSP00000412893
MASVWQRLGFYASLLKRQLNGGPDVIKWERRVIPGCTRSIYSATGKWTKEYTLQTRKDVEKWWHQRIKEQASKISEADVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 30714 - protein, 114 aa, Homo sapiens
  ENSP00000401388
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARF

SEQ ID NO: 30715 - protein, 105 aa, Homo sapiens
  ENSP00000378733
MSIYFPIHCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 30716 - protein, 43 aa, Homo sapiens
  ENSP00000392167
MSIYFPIHCPDYLRSAKMTEVMMNTQPMEEIGLSPRKDGLSYQ

SEQ ID NO: 30717 - protein, 52 aa, Homo sapiens
  ENSP00000385409
MSIYFPIHCPDYLRSAKMTEVMMNTQPMEEIGLSPRKDGLSYQVNLPRPVRF

SEQ ID NO: 30718 - protein, 48 aa, Homo sapiens
  ENSP00000384443
MSIYFPIHCPDYLRSAKMTEVMMNTQPMEEIGLSPRKDGLSYQDCEEP

SEQ ID NO: 30719 - protein, 111 aa, Homo sapiens
  ENSP00000385703
MQVSTSRPAAAGLSCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 30720 - protein, 88 aa, Homo sapiens
  ENSP00000386106
MTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 30721 - protein, 281 aa, Homo sapiens
  ENSP00000359212
MTSKEDGKAAPGEERRRSPLDHLPPPANSNKPLTPFSIEDILNKPSVRRSYSLCGAAHLLAAADKHAQGGLPLAGRALLSQTSPLCALEELASKTFKGLEVSVLQAAEGRDGMTIFGQRQTPKKRRKSRTAFTNHQIYELEKRFLYQKYLSPADRDQIAQQLGLTNAQVITWFQNRRAKLKRDLEEMKADVESAKKLGPSGQMDIVALAELEQNSEATAGGGGGCGRAKSRPGSPVLPPGAPKAPGAGALQLSPASPLTDQPASSQDCSEDEEDEEIDVDD

SEQ ID NO: 30722 - protein, 440 aa, Homo sapiens
  ENSP00000264005
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 30723 - protein, 138 aa, Homo sapiens
  ENSP00000463220
VQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASETGSHCIA

SEQ ID NO: 30724 - protein, 107 aa, Homo sapiens
  ENSP00000459014
  MOD_RES (1)..(1): Any amino acid
XLPLGVDCWIDNTRVVYNRSSGLVSNAPGVQIRVPGFGKTYSVEYLDSSKLAGPPATACAPAAPARDTASQHGLQQPDPGAHQCHPAGCLPPGSPCIPDCQPRAPAS

SEQ ID NO: 30725 - protein, 255 aa, Homo sapiens
  ENSP00000464651
MCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAG

SEQ ID NO: 30726 - protein, 93 aa, Homo sapiens
  ENSP00000460653
MGPPGSPWQWVTLLLGLLLPPAAPFWLLNVLFPPHTTPKAELSNHTRPVILARSQAGQTRCGELDVLPQDRGLLHHLAGSQHVPTPWGRLLDR

SEQ ID NO: 30727 - protein, 80 aa, Homo sapiens
  ENSP00000458141
  MOD_RES (1)..(1): Any amino acid
XEYYRKLAGLVEEMHAAYGKPVFLIGHSLGCLHLLYFLLRQPQAWKDRFIDGFISLGAPWGGSIKPMLVLASGSGTRAQH

SEQ ID NO: 30728 - protein, 61 aa, Homo sapiens
  ENSP00000459291
SPRPGRTALLMASSLLGLPGVAPSSPCWSWPQECLCPGMCFTEDGSARARARPPEAPPALP

SEQ ID NO: 30729 - protein, 152 aa, Homo sapiens
  ENSP00000360753
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 30730 - protein, 175 aa, Homo sapiens
  ENSP00000482512
MPGAAEALPTVTVTLVAGAVPPASGALTAHCIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 30731 - protein, 1871 aa, Homo sapiens
  ENSP00000490600
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGSTVDAKSEEATKMEKRKSALNKVLESLCIHHQQQVLAMLKFLVQEQNAASLCCCNTSCVVSSESQKPLIEDDLCGLFCSCEYRLAERGCLQNEKQSPGLEPLPVCIKDLHCLSCQTVTVEHVKPVVNRGIADSYNSHRCCSGLLPNIHSTKSAFRSPLLSKEVCDLSVTLKDACRSRSPSPPPLSPIETEGFEKLKDVISEISALENNKLEANINQPPSLTPAEISSNKSDHQDKILKTKKSSNSYSLLSNDSNNSTTNHEKGETAVIFQDLMDRINEKLKSIETTDMTSLVKLSSSDYNTYNDLKLGDFITSLLHNAKASDYSFMELLSQHDKKVENKIIQTRFRKRQETLFAMRNSSDSPMFRRQSLQIKRELASLDENFTRKKYTEKSSRKLTQNNEISSSDKGEFYHDQGPSLQNSKRLQGKNHAETSFSPNYALQSLQLPLHSSETNLSFNEFSESFKTTSPEKMSIRKPQEKSADGKQFLQNDRKNPKLGNTQTLLRNDVSGLLSRTKRNIVPPGWYSVYVTNNYVFKKSPKAKKVSESTTKNDPVKNIHIESSHNIDLNKIAMNSNLQVVVKRLEDTISIAKKSWNNQPLSEGYKASKKLIEIDGKDQHADRNMTLTLNRMTCKEQSLSKSVVASGNIINSHCMPTVDLNNKRLENLKKSSILDMGRLISSVENVPAKYEGTESSSVSNYSSPIKLMFLSEVKSSEGVKYTLTSVGTSHSNVVLPSEKPTTHHVTEEKTETNEDISNANSENYHSSHYDTDTFQRELNKFSHAKETAGSSTMFIGDINSDKPQEEPKDNSSSATDPSFKRKPGRPKKIGPQVVKQIKRPIGRPPKPKIDQTNITVCQNEPFSAGRKSPECLISEVKEGIYKKSITVTVIYGRSRRTKRHVSEGRVNISNLMSLNNNAGDFPTEYNSPRNISEDKIDLGERISAVASLTTESEILGSGFEYVRPIKNKSVIPQPSKNIIRPNQKPLAISRKPGRPAKVKISGISVTINRTSPQEREVSISSCLPPLEQDNTSGKNLPEEKYDQQCTQMDKIRHTEADIFKNGSKRMIATVPLRHSIRDRKPSLHFLHSLASSSSLIYRNALLHKSYKLHLQKNKSQKEKHRHSKMKIAYKDTPRNRLSRNAKKCLEDNKLVPISEVSLDPIISSNPLLRWWATSASNDSLLEELNNRFEQITNAWVQVSGDEAENCIHKKREHIENDHFKVASPLETCLLELEVSPVKMLFQKKYDLNELCTWFMQTTETQSLSLVRKANARNPLEVINTRGIKLGTKYSDFNASPFRKHFKKFALSSPSKSAEKLHILHKVANSPLLNVKSNLAIARLKRTEFKRLHHERWKREGKLHNHGTVDWNSKRRNLRFFCQNQFLNKTEGETNADIPLQGKSIVDNQCVLPPEIRGDLQQRVVMPDFKIHASFENKFKSEAKENGTNCSQKDFQKGPRLENVCPNSWRSKTLKDCRIFLRKLNCLEHRNTFKLNTIIYSPESTDSGNTHQTHMEESKRFTLRSHSARQNSFKKQSKEIENANTNNPSADEFADHLGNSKLSKCVNFDKNPDSFEVLSNLNKRKRPPWKITEMSTKRHKRQSCNSGQMANYFSKSLACYK

SEQ ID NO: 30732 - protein, 318 aa, Homo sapiens
  ENSP00000317566
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 30733 - protein, 77 aa, Homo sapiens
  ENSP00000490873
  MOD_RES (1)..(1): Any amino acid
XGRERMAAAAAAAAAAAAAAQCRSPRCAAERRGFRRELDSWRHRLMHCVGFESILEGLYGPRLRRDLSLFEGLYTIS

SEQ ID NO: 30734 - protein, 79 aa, Homo sapiens
  ENSP00000423489
MDKGRERMAAAAAAAAAAAAAAQCRSPRCAAERRGFRRELDSWRHRLMHCVGFESILEGLYGPRLRRDLSLFEGLYTIS

SEQ ID NO: 30735 - protein, 518 aa, Homo sapiens
  ENSP00000371659
MDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 30736 - protein, 602 aa, Homo sapiens
  ENSP00000371661
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 30737 - protein, 240 aa, Homo sapiens
  ENSP00000384267
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKIGNPSWHYHSLRTMRCPSAQILKPPDERFGSDLLPTYWWKNQISRD

SEQ ID NO: 30738 - protein, 370 aa, Homo sapiens
  ENSP00000370480
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKIGNPSWHYHSLRTMRCPSAQILKPPDERFGSDLLPTYWWKNQISRD

SEQ ID NO: 30739 - protein, 325 aa, Homo sapiens
  ENSP00000237822
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 30740 - protein, 277 aa, Homo sapiens
  ENSP00000487592
MDSELKEEIPVHEEFILCGGAETQVLKCGPWTDLFHDQSVKRPKLLIFIIPDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 30741 - protein, 130 aa, Homo sapiens
  ENSP00000396911
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHL

SEQ ID NO: 30742 - protein, 159 aa, Homo sapiens
  ENSP00000400910
MDSELKEEIPVHEEFILCGGAETQVLKCGPWTDLFHDQSVKRPKLLIFIIPDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKS

SEQ ID NO: 30743 - protein, 146 aa, Homo sapiens
  ENSP00000385951
MDSELKEEIPVHEEFILCGGAETQVLKCGPWTDLFHDQSVKRPKLLIFIIPGERKSLGNPGFSAFYVPFAKALYSLTNRRFPVWTISHAGHALAPKDKKILTTSEDSNAQEIKDIYGLNGQIEHKLAFLRTHVPKDMKLVLIGHSI

SEQ ID NO: 30744 - protein, 156 aa, Homo sapiens
  ENSP00000414710
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEGGILAVLSWWTQEASPLGTLAGSTLMTPSDPNYFPKTPLHLLIAFGHRVSPMDLGAI

SEQ ID NO: 30745 - protein, 195 aa, Homo sapiens
  ENSP00000483067
MKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 30746 - protein, 195 aa, Homo sapiens; identical to SEQ ID NO: 30745
  ENSP00000440570

SEQ ID NO: 30747 - protein, 166 aa, Homo sapiens
  ENSP00000400340
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPLMLPTLGAKK

SEQ ID NO: 30748 - protein, 283 aa, Homo sapiens
  ENSP00000388635
MDSELKEEIPVHEEFILCGGAETQVLKCGPWTDLFHDQSVKRPKLLIFIIPGERKSLDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKLTFYYGTIDPWCPKEYYEDIKKDFPEGDIRLCEKNIPHAFITHFNQEMADMIADSLKDDLSKM

SEQ ID NO: 30749 - protein, 371 aa, Homo sapiens
  ENSP00000422552
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQDVMVVGEPTLMGGEFGDEDERLITRLENTQYDAANGMDDEEDFNNSPALGNNSPWNSKPPATQETKSENPPPQASQ

SEQ ID NO: 30750 - protein, 331 aa, Homo sapiens
  ENSP00000392089
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 30751 - protein, 373 aa, Homo sapiens
  ENSP00000306772
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 30752 - protein, 313 aa, Homo sapiens
  ENSP00000423963
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPIASIARSPVSGCALRT

SEQ ID NO: 30753 - protein, 294 aa, Homo sapiens
  ENSP00000425754
  MOD_RES (1)..(1): Any amino acid
XIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 30754 - protein, 110 aa, Homo sapiens
  ENSP00000424770
MSSTPHDPFYSSPFGPFYRRHTPYMVQPEYRIYEMNKRLQSRTEDSDNLWWDAFATEFFEDDATLTLSFCLEDGPKRYIVHSAADARGNCNQLGDSEPDACDGLLQFPIM

SEQ ID NO: 30755 - protein, 106 aa, Homo sapiens
  ENSP00000424676
MSSTPHDPFYSSPFGPFYRRHTPYMVQPEYRIYEMNKRLQSRTEDSDNLWWDAFATEFFEDDATLTLSFCLEDGPKRYRTKNLRPIGEKMNINGKCYRQDPHPPLL

SEQ ID NO: 30756 - protein, 164 aa, Homo sapiens
  ENSP00000421767
MVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLS

SEQ ID NO: 30757 - protein, 732 aa, Homo sapiens
  ENSP00000485500
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 30758 - protein, 283 aa, Homo sapiens
  ENSP00000361136
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 30759 - protein, 727 aa, Homo sapiens
  ENSP00000355296
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 30760 - protein, 330 aa, Homo sapiens
  ENSP00000485389
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 30761 - protein, 398 aa, Homo sapiens
  ENSP00000361126
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 30762 - protein, 617 aa, Homo sapiens
  ENSP00000263066
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 30763 - protein, 81 aa, Homo sapiens
  ENSP00000485538
VMHALRQTWHTTCFVCAACKKPFGNSLFHMEDGEPYCEKDYINLFSTKCHGCDFPVEAGDKFIEALGHTWHDTCFICAVCL

SEQ ID NO: 30764 - protein, 732 aa, Homo sapiens; identical to SEQ ID NO: 30757
  ENSP00000401437

SEQ ID NO: 30765 - protein, 231 aa, Homo sapiens
  ENSP00000438866
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGW

SEQ ID NO: 30766 - protein, 333 aa, Homo sapiens
  ENSP00000388576
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQEGESMTFDPRLDHEGICCIECRRSYTHCQKICEPLGGYYPWPYNYQGCRSACRVIMPCSWWVARILGMV

SEQ ID NO: 30767 - protein, 334 aa, Homo sapiens
  ENSP00000367198
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 30768 - protein, 129 aa, Homo sapiens
  ENSP00000396035
MSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPK

SEQ ID NO: 30769 - protein, 131 aa, Homo sapiens
  ENSP00000429618
MFSTKALLLAGLISTALAGPWANICAGKSSNEIRTCDRHGCGQYSAQRSQRPHQGVDILCSAGSTVYAPFTGMIVGQEKPYQNKNAINNGVRISGREITTDTPIFNNYYPDQSAAVNIKTRSSTSKKMMTH

SEQ ID NO: 30770 - protein, 151 aa, Homo sapiens
  ENSP00000274507
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 30771 - protein, 79 aa, Homo sapiens
  ENSP00000427012
MIVGQEKPYQNKNAINNGVRISGRGFCVKMFYIKPIKYKGPIKKGEKLGTLLPLQKVYPGIQSHVHIENCDSSDPTAYL

SEQ ID NO: 30772 - protein, 111 aa, Homo sapiens
  ENSP00000421123
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGKRGGVYTWGASWRC

SEQ ID NO: 30773 - protein, 501 aa, Homo sapiens
  ENSP00000483600
MGSRPPCGATSSARRACQFPAPMAAAREPELPQEAPATEPAPPPACRFFLEGRCRFGARCRQPHPGAPAPPGREAQPEAGAKKPPLRTAADVIQRIRWDPRLDPADFSVGYVDRFLGVREEPFSAFCWDQPLAALGPGVLAVPQHRVRFFRFHGRLVWDRASRTDLVFGSGSAAGRGPTILDAPNTEGAHGAEGAEWTLAGTGQEAQAAPKRGSTRPLCTGHQEPGVEEPGELEAAQERALGTAADLGTLAPRGRLAGVTEEALKPTAATRTTLLGGKEAQALGVPGGSAETTEAEWGPAAWPEDKRARLSVAAPCQPRPTHFVALMVTEPGLQAEVTKAQEYLVHVAPHCANFLVPSQNLHLTLALLRLAGAGEEAAAIGALRRALLAPGLNAPPRLSFRKLVLLGPHVLCAPPSPTLESMAQVLSQRLEAEGLSTLQSPGQLHPHLTVAKVPHGSQVHLPKLEFTLSQEVGCQPLQTLWLCRIGRTGGPFQPLAEIRLE

SEQ ID NO: 30774 - protein, 478 aa, Homo sapiens
  ENSP00000479355
MAAAREPELPQEAPATEPAPPPACRFFLEGRCRFGARCRQPHPGAPAPPGREAQPEAGAKKPPLRTAADVIQRIRWDPRLDPADFSVGYVDRFLGVREEPFSAFCWDQPLAALGPGVLAVPQHRVRFFRFRGRLVWDRASRTDLVFGSGSAAGRGPTILDAPNTEGAHGAEGAEWTLAGTGQEAQAAPKRGSTRPLCTGHQEPGVEEPGELEAAQERALGTAADLGTLAPRGRLAGVTEALKPTAATRTTLLGGKEAQALGVPGGSAETTEAEWGPAAWPEDKRARLSVAAPCQPRPTHFVALMVTEPGLQAEVTKAQEYLVHVAPHCANFLVPSQNLHLTLALLRLAGAGEEAAAIGALRRALLAPGLNAPPRLSFRKLVLLGPHVLCAPPSPTLESMAQVLSQRLEAEGLSTLQSPGQLHPHLTVAKVPHGSQVHLPKLEFTLSQEVGCQPLQTLWLCRIGRTGGPFQPLAEIPLE

SEQ ID NO: 30775 - protein, 501 aa, Homo sapiens; identical to SEQ ID NO: 30773
  ENSP00000477636

SEQ ID NO: 30776 - protein, 478 aa, Homo sapiens; identical to SEQ ID NO: 30774
  ENSP00000478498

SEQ ID NO: 30777 - protein, 308 aa, Homo sapiens
  ENSP00000385764
MDEQTGRLRLDTYCMSAKQIWAWSKCSGRLWDEHMKWMEGWTDRWTDGWMDGWMDEWSPTPALRSYGGGLSQQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 30778 - protein, 250 aa, Homo sapiens
  ENSP00000384786
MTPGRCCLAADIQVETFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 30779 - protein, 379 aa, Homo sapiens
  ENSP00000222725
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 30780 - protein, 361 aa, Homo sapiens
  ENSP00000352579
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRWGN

SEQ ID NO: 30781 - protein, 250 aa, Homo sapiens; identical to SEQ ID NO: 30778
  ENSP00000343095

SEQ ID NO: 30782 - protein, 248 aa, Homo sapiens
  ENSP00000483986
MKGCLLKADFLLQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 30783 - protein, 88 aa, Homo sapiens
  ENSP00000451526
MADNFSLHDALSGSGNPNPQGWPGAWGNQPAGAGGYPGASYPGAYPGQAPPGAYPGQAPPGAYPGAPGAYPGAPAPGVYPGPPSGPGA

SEQ ID NO: 30784 - protein, 250 aa, Homo sapiens [sequence omitted]

SEQ ID NO: 30785 - protein, 233 aa, Homo sapiens
  ENSP00000451381
MADNFSLHDALSGSGNPNPQGWPGAWGNQPAGAGGYPGASYPGAYPGQAPPGAYPGQAPPGAYPGAPGAYPGAPAPGVYPGPPSGPGAYPSSGQPSATGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKSLALSPGWSTVARSWLTTTSASWVQAMLLPQPPK

SEQ ID NO: 30786 - protein, 545 aa, Homo sapiens
  ENSP00000371548
MALRRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 30787 - protein, 256 aa, Homo sapiens
  ENSP00000426254
  MOD_RES (1)..(1): Any amino acid
XLGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDKQEEICEGKIQNLNARVVMNCSRPSSAFRKHTGNGRVAFFLPHGVR

SEQ ID NO: 30788 - protein, 537 aa, Homo sapiens
  ENSP00000312273
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 30789 - protein, 494 aa, Homo sapiens
  ENSP00000376059
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPGEPPPRPSACPAACLAGLTCLPTSPQRPPWCPASHWCWARASSCWLPACGGAHSCGPGPVPACAWPQRRPWPRGGCCGPMTPSSCGWKGNPASWWPMPPRRAAPRCCAATGPAFTRTRACTPGTGTRTLRPWSWTAGPTCCWPRLPSGPCSSTGPVAASRDAQTSPRPRMSMPHATSRLVGTCSCASHATLGTPWSCAGTAPCFVCCSNFPRAVPTSSSHCSSPGTSWPS

SEQ ID NO: 30790 - protein, 378 aa, Homo sapiens
  ENSP00000467044
  MOD_RES (1)..(1): Any amino acid
XVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVRLGLGAGGWLFSTDPILHTKPLNSDLPSHADL

SEQ ID NO: 30791 - protein, 261 aa, Homo sapiens
  ENSP00000467784
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 30792 - protein, 907 aa, Homo sapiens
  ENSP00000266674
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 30793 - protein, 835 aa, Homo sapiens
  ENSP00000443033
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 30794 - protein, 883 aa, Homo sapiens
  ENSP00000441035
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 30795 - protein, 967 aa, Homo sapiens
  ENSP00000356247
MPSPPGLRALWLCAALCASRRAGGAPQPGPGPTACPAPCHCQEDGIMLSADCSELGLSAVPGDLDPLTAYLDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 30796 - protein, 915 aa, Homo sapiens
  ENSP00000255432
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 30797 - protein, 348 aa, Homo sapiens
  ENSP00000422143
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEMRSGGLYFLPPSARGAWSGARV

SEQ ID NO: 30798 - protein, 232 aa, Homo sapiens
  ENSP00000402284
MNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLDLNYNKLQEFPVAIRTLGRLQELSLNGAMDIQEFPDLKGTTSLEILTLTRAGIRLLPSGMCQQLPRLRVLELSHNQIEELPSLHRCQKLEE

SEQ ID NO: 30799 - protein, 828 aa, Homo sapiens
  ENSP00000387869
MRLEGEGRSARAGQNLSRAGSARRGAPRDLSMNNLTELQPGLFHHLRFLEELRLSGNHLSHIPGQAFSGLYSLKILMLQNNQLGGIPAEALWELPSLQSLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 30800 - protein, 200 aa, Homo sapiens
  ENSP00000368908
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 30801 - protein, 228 aa, Homo sapiens
  ENSP00000425906
MCHVIVTCRSMLWTLLSIVVAFAELIAFMSADWLIGKARSRGGVEPAGPGGGSPEPYHPTLGIYARCIRNPGVQHFQRDTLCGPYAESFGEIASGFWQATAIFLAVGIFILCMVALVSVFTMCVQSIMKKSIFNVCGLLQGIAGLFLILGLILYPAGWGCQKAIDYCGHYASAYKPGDCSLGWAFYTAIGGTVLTFICAVFSAQAEIATSSDKVQEEIEEGKNLICLL

SEQ ID NO: 30802 - protein, 228 aa, Homo sapiens; identical to SEQ ID NO: 30801
  ENSP00000369702

SEQ ID NO: 30803 - protein, 222 aa, Homo sapiens
  ENSP00000393128
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 30804 - protein, 218 aa, Homo sapiens
  ENSP00000385374
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKDDGNA

SEQ ID NO: 30805 - protein, 406 aa, Homo sapiens
  ENSP00000484449
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 30806 - protein, 141 aa, Homo sapiens
  ENSP00000488248
  MOD_RES (1)..(1): Any amino acid
XRPLVDRLEPGELIPNGPFSFYGASRTILLLGRPDGKGGHEIGSKSASRWDWDPRTGCRRAELGLPKGNADLSPTPTWTRIRRQTPRACAPGRRAAKRRPGQPRVRTAVGDARSRGEGGREHSRVKEVKRPRALPGQPGGF

SEQ ID NO: 30807 - protein, 406 aa, Homo sapiens; identical to SEQ ID NO: 30805
  ENSP00000477829

SEQ ID NO: 30808 - protein, 141 aa, Homo sapiens; identical to SEQ ID NO: 30806
  ENSP00000481496
  MOD_RES (1)..(1): Any amino acid

SEQ ID NO: 30809 - protein, 402 aa, Homo sapiens
  ENSP00000261731
MMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 30810 - protein, 620 aa, Homo sapiens
  ENSP00000394537
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEVRCPSRHAPRGF

SEQ ID NO: 30811 - protein, 676 aa, Homo sapiens
  ENSP00000273317
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 30812 - protein, 169 aa, Homo sapiens
  ENSP00000397253
  MOD_RES (1)..(1): Any amino acid
XGVPICGACRRPIEGRVVNALGKQWHVEVSQAGGHVASGWGVPQLRVMHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30813 - protein, 189 aa, Homo sapiens
  ENSP00000386252
MFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30814 - protein, 189 aa, Homo sapiens; identical to SEQ ID NO: 30813
  ENSP00000386345

SEQ ID NO: 30815 - protein, 365 aa, Homo sapiens
  ENSP00000326888
MAARLGALAASGLYRRRQHRQSPPPATGNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30816 - protein, 336 aa, Homo sapiens
  ENSP00000386383
MSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30817 - protein, 341 aa, Homo sapiens
  ENSP00000347240
MTGSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30818 - protein, 336 aa, Homo sapiens; identical to SEQ ID NO: 30816
  ENSP00000386637

SEQ ID NO: 30819 - protein, 336 aa, Homo sapiens; identical to SEQ ID NO: 30816
  ENSP00000387002

SEQ ID NO: 30820 - protein, 189 aa, Homo sapiens; identical to SEQ ID NO: 30813
  ENSP00000386570

SEQ ID NO: 30821 - protein, 363 aa, Homo sapiens
  ENSP00000443794
MTGRKRKWGETGTGSGAAPAAALRWSNMSDALANAVCQRCQARFSPAERIVNSNGELYHEHCFVCAQCFRPFPEGLFYEFEGRKYCEHDFQMLFAPCCGSCGEFIIGRVIKAMNNNWHPGCFRCELCDVELADLGFVKNAGRHLCRPCHNREKAKGLGKYICQRCHLVIDEQPLMFRSDAYHPDHFNCTHCGKELTAEARELKGELYCLPCHDKMGVPICGACRRPIEGRVVNALGKQWHVEHFVCAKCEKPFLGHRHYEKKGLAYCETHYNQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 30822 - protein, 60 aa, Homo sapiens
  ENSP00000388611
MFRSDAYHPDHFNCTHCGTLSVPSVRSHSWGTGTMRRRAWPTARLTTTSSSGTSATTAAM

SEQ ID NO: 30823 - protein, 189 aa, Homo sapiens; identical to SEQ ID NO: 30813
  ENSP00000386907

SEQ ID NO: 30824 - protein, 250 aa, Homo sapiens
  ENSP00000344401
MAEGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 30825 - protein, 258 aa, Homo sapiens
  ENSP00000490468
MRSFNQVSSAPGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 30826 - protein, 209 aa, Homo sapiens
  ENSP00000489735
MSHRRQVLQKRMRSFNQVSSAPGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTST

SEQ ID NO: 30827 - protein, 233 aa, Homo sapiens
  ENSP00000447488
MLKPSVTSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 30828 - protein, 101 aa, Homo sapiens
  ENSP00000261203
MLKPSVTSAPTADMATLTVVQPLTLDRDVARAIELLEKLQESGEVPVHKLQSLKKVLQSEFCTAIREVYQYMHETITVNGCPEFRARATAKVFSCVHCKRI

SEQ ID NO: 30829 - protein, 180 aa, Homo sapiens
  ENSP00000448975
TSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVLLRSQKQMETHVSSAIIGRENFFYP

SEQ ID NO: 30830 - protein, 130 aa, Homo sapiens
  ENSP00000448891
  MOD_RES (1)..(1): Any amino acid
XLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVVCL

SEQ ID NO: 30831 - protein, 620 aa, Homo sapiens
  ENSP00000347451
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 30832 - protein, 614 aa, Homo sapiens
  ENSP00000453853
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 30833 - protein, 326 aa, Homo sapiens
  ENSP00000453780
MVQLEQKVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGG

SEQ ID NO: 30834 - protein, 178 aa, Homo sapiens
  ENSP00000455605
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISH

SEQ ID NO: 30835 - protein, 125 aa, Homo sapiens
  ENSP00000454465
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRL

SEQ ID NO: 30836 - protein, 72 aa, Homo sapiens
  ENSP00000454687
MLAGGVRSMPSPLLACWQPILLLVLGSVLSGSATGCPPRCECSAQDRAVLCHRKRFVAVPEGIPTETRLLDL

SEQ ID NO: 30837 - protein, 55 aa, Homo sapiens
  ENSP00000454051
MLAGGVRSMPSPLLACWQPILLLVLGSVLSGSATGCPPRCECSAQDRAVLCHRKR

SEQ ID NO: 30838 - protein, 35 aa, Homo sapiens
  ENSP00000454245
MLAGGVRSMPSPLLACWQPILLLVLGSVLSGSATG

SEQ ID NO: 30839 - protein, 18 aa, Homo sapiens
  ENSP00000454577
MLAGGVRSMPSPLLACWQ

SEQ ID NO: 30840 - protein, 11 aa, Homo sapiens
  ENSP00000456516
MLAGGVRSMPS

SEQ ID NO: 30841 - protein, 4 aa, Homo sapiens
  ENSP00000457101
MLAG

SEQ ID NO: 30842 - protein, 606 aa, Homo sapiens
  ENSP00000369328
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 30843 - protein, 606 aa, Homo sapiens; identical to SEQ ID NO: 30842
  ENSP00000479634

SEQ ID NO: 30844 - protein, 606 aa, Homo sapiens; identical to SEQ ID NO: 30842
  ENSP00000310126

SEQ ID NO: 30845 - protein, 390 aa, Homo sapiens
  ENSP00000463835
MLSFSRDRLPSGRRVSGKCPPPPLGMAVGRGGSGCPEEGSGRKLELLESQLPAERAREEAGPSVRRPRDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 30846 - protein, 24 aa, Homo sapiens
  ENSP00000463077
MTAKTFFIIHGWTMSGIFENWLHK

SEQ ID NO: 30847 - protein, 500 aa, Homo sapiens
  ENSP00000261292
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 30848 - protein, 426 aa, Homo sapiens
  ENSP00000387978
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITAITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 30849 - protein, 354 aa, Homo sapiens
  ENSP00000462420
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 30850 - protein, 188 aa, Homo sapiens
  ENSP00000462480
LCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQVLGDERESPVTSRISNPIFLRNAGHASVAMNFWSLIKIFEIKSFIEL

SEQ ID NO: 30851 - protein, 161 aa, Homo sapiens
  ENSP00000459533
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 30852 - protein, 152 aa, Homo sapiens
  ENSP00000397958
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGQECSGTIVALRSFDLLGSCNPPSSAS

SEQ ID NO: 30853 - protein, 161 aa, Homo sapiens; identical to SEQ ID NO: 30851
  ENSP00000340118

SEQ ID NO: 30854 - protein, 161 aa, Homo sapiens; identical to SEQ ID NO: 30851
  ENSP00000459138

SEQ ID NO: 30855 - protein, 75 aa, Homo sapiens
  ENSP00000459603
MSVPGPYQAATGPSSAPSAPPSYEETVAVNSYYPTPPAPMPGPTTGLVTGPDGKGMNPPSYYTQPAPIPNNNPSA

SEQ ID NO: 30856 - protein, 10 aa, Homo sapiens
  ENSP00000459094
  MOD_RES (1)..(1): Any amino acid
XRSDSAKESK

SEQ ID NO: 30857 - protein, 81 aa, Homo sapiens
  ENSP00000460873
MSVPGPYQAATGPSSAPSAPPSYEETVAVNSYYPTPPAPMPGPTTGLVTGPDGKGMNPPSYYTQPAPIPNNNPMNAIGLVS

SEQ ID NO: 30858 - protein, 68 aa, Homo sapiens
  ENSP00000458836
MCCPSCNKMIVSQLSYNAGALTWLSCGSLCLLGCIAGCCFIPFCVDALQDVDHYCPNCRALLGTYKRL

SEQ ID NO: 30859 - protein, 161 aa, Homo sapiens; identical to SEQ ID NO: 30851
  ENSP00000461667

SEQ ID NO: 30860 - protein, 161 aa, Homo sapiens; identical to SEQ ID NO: 30851
  ENSP00000461813

SEQ ID NO: 30861 - protein, 153 aa, Homo sapiens
  ENSP00000460743
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRA

SEQ ID NO: 30862 - protein, 137 aa, Homo sapiens
  ENSP00000458871
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFC

SEQ ID NO: 30863 - protein, 136 aa, Homo sapiens
  ENSP00000458981
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGQECSGTIVAL

SEQ ID NO: 30864 - protein, 126 aa, Homo sapiens
  ENSP00000460133
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLG

SEQ ID NO: 30865 - protein, 105 aa, Homo sapiens
  ENSP00000459913
MSVPGPYQAATGPSSAPSAPPSYEETVAVNSYYPTPPAPMPGPTTGLVTGPDGKGMNPPSYYTQPAPIPNNNPSTCGLPGPPYHSLALHPGNQESDRSDSAKESK

SEQ ID NO: 30866 - protein, 88 aa, Homo sapiens
  ENSP00000459898
MTFVNCHGAGGSVAVRKTRVRPRRRLGFGKMSVPGPYQAATGPSSAPSAPPSYEETVAVNSYYPTPPAPMPGPTTGLVTGPDGKGMNP

SEQ ID NO: 30867 - protein, 39 aa, Homo sapiens
  ENSP00000459026
MSVPGPYQAATGPSSAPSAPPSYEETVAVNSYYPTPPAP

SEQ ID NO: 30868 - protein, 33 aa, Homo sapiens
  ENSP00000458538
MTFVNCHGAGGSVAVRKTRVRPRRRLGFGKMSV

SEQ ID NO: 30869 - protein, 152 aa, Homo sapiens; identical to SEQ ID NO: 30852
  ENSP00000481589

SEQ ID NO: 30870 - protein, 161 aa, Homo sapiens; identical to SEQ ID NO: 30851
  ENSP00000483114

SEQ ID NO: 30871 - protein, 228 aa, Homo sapiens
  ENSP00000371231
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGVHSGLLLHPLLRGCPAGRGPLLSQLQSSPGHLQAFVGLSQTWREPGAAGSPFHLSSSFTPGGGSALVVSPLQGAHLHVFFWGEYVAKLTNLQTPEIAAWSRA

SEQ ID NO: 30872 - protein, 365 aa, Homo sapiens
  ENSP00000157600
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 30873 - protein, 247 aa, Homo sapiens
  ENSP00000411222
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYKPVPLV

SEQ ID NO: 30874 - protein, 233 aa, Homo sapiens
  ENSP00000400555
MGYTYKVIERILEIGAFRPHMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAAT

SEQ ID NO: 30875 - protein, 292 aa, Homo sapiens
  ENSP00000396515
MDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 30876 - protein, 58 aa, Homo sapiens
  ENSP00000405049
MAKVAKDLNPGVKKMSLGQLQSARGVACLGCKGTCSGFEPHSWRDCSTWSSSPRRSSQ

SEQ ID NO: 30877 - protein, 253 aa, Homo sapiens
  ENSP00000380542
MFGMQGDVFGLRATFMEGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 30878 - protein, 634 aa, Homo sapiens
  ENSP00000478197
MRWLRPAGRRREQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 30879 - protein, 302 aa, Homo sapiens
  ENSP00000488238
MATVYSPSLPGLLGGRASEQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSF

SEQ ID NO: 30880 - protein, 247 aa, Homo sapiens
  ENSP00000488391
MAPKSGQEVKETEEEALLSPTEQESVSGHLGPPAGAPAAPETPTCLPDTTPHPTPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQ

SEQ ID NO: 30881 - protein, 634 aa, Homo sapiens
  ENSP00000331167
MRWLRPAGRRREQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSFVQVIGHPPRDHRASSEQALVQAGSYSRDSEDLQKTHSPRHGEPVLSPQPCTDPDHWSPELLQSPTGLKIVAVSCREKFVRIFNPSQESTADLSGMVLKQLVRGFPERLYRFPPGTLLAPRHHVTVWGEATRSAKKPLRASSSREPVPLLSIRGCATLLLSPKGEVLSEHRIPRRETPAPRVFADGTDLSIDRFPLPEAGPGADTRKPPRPPRPLRKGRVREPRVSRRRPGTRGLLPPVSSGKLFHAREGPARPENPEIPAPQHLPAIPGDPTLPSPPAEAGLGLEDCRLQKEHRVRVCRKSVDRSCPLVALSVQNTAESRFGFRFLSCLPVTADTCRGA

SEQ ID NO: 30882 - protein, 302 aa, Homo sapiens
  ENSP00000393529
MATVYSPSLPGLLGGRASEQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQKQPRPWPQLDTGSPESSGKHSERHHKTVEWGSLPCLNTSSSGGADSDSSSCRPGLPSF

SEQ ID NO: 30883 - protein, 247 aa, Homo sapiens
  ENSP00000435529
MAPKSGQEVEETEEEALLSPTEQESVSGHLGPPAGAPAAPETPTCLPDTTPHPAPVVCSADPQLALESLDPRTLRLLWRQRELEIQALRWAIQNGEDARLCHILEEVAGLPPKRSSHSQEKLLQNQVQKLIQELKEQKERAQWEKEHLEERLLQTTRTLQEMEAELQNLQKSCLLQLARSSWVGRMLRSQTGSVEVVTAETLMDPSDLSENIQAPTGEGFRLEDVDWNSVARRYPNLFTNMEPSSKQ

SEQ ID NO: 30884 - protein, 55 aa, Homo sapiens
  ENSP00000401967
MSSAIERKSLDPSESLKGSQVRCPVWPKTISDPRCWSHSGEAVPDAWPSLQGTSG

SEQ ID NO: 30885 - protein, 158 aa, Homo sapiens
  ENSP00000379175
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 30886 - protein, 227 aa, Homo sapiens
  ENSP00000257818
MEGSAVTVLERGGASSPAERRSKRRRRSGGDGGGGGGARAPEGVRAPAAGQPRATKGAPPPPGTPPPSPMSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 30887 - protein, 211 aa, Homo sapiens [sequence omitted]

SEQ ID NO: 30888 - protein, 54 aa, Homo sapiens
  ENSP00000457686
MPVRNVYKKEKARVITEEEKNFKAFASLRMARANARLFGIRAKRAKEAAEQDVE

SEQ ID NO: 30889 - protein, 211 aa, Homo sapiens [sequence omitted]

SEQ ID NO: 30890 - protein, 63 aa, Homo sapiens
  ENSP00000457174
MAPSRNGMVLKPHFHKDWQRRVATWFNQPARKIRRRWPGPSAFLWIRGGGTSPRSPCRPTCSG

SEQ ID NO: 30891 - protein, 164 aa, Homo sapiens
  ENSP00000438959
MAPSRNGMVLKPHFHKDWQRRVATWFNQPARKIRRRKARQAKARRIAPRPASGPIRPIVRCPTVRYHTKVRAGRGFSLEELRVAGIHKKGDSSAEELKLATQLTGPVMPVRNVYKKEKARVITEEEKNFKAFASLRMARANARLFGIRAKRAKEAAEQDVEKKK

SEQ ID NO: 30892 - protein, 126 aa, Homo sapiens
  ENSP00000464612
MAPSRNGMVLKPHFHKDWQRRVATWFNQPARKIRRRKARQAKARRIAPRPASGPIRPIVRCPTVRYHTKVRAGRGFSLEELRVAGIHKKVARTIGISVDPRRRNKSTESLQANVQRLKEYRSKLIL

SEQ ID NO: 30893 - protein, 211 aa, Homo sapiens [sequence omitted]

SEQ ID NO: 30894 - protein, 78 aa, Homo sapiens
  ENSP00000462380
  MOD_RES (1)..(1): Any amino acid
XPVMPVRNVSEHLLKSRLQTRSVGEHVYKKEKARVITEEEKNFKAFASLRMARANARLFGIRAKRAKEAAEQDVEKKK

SEQ ID NO: 30895 - protein, 305 aa, Homo sapiens
  ENSP00000489863
MASNRQRSLRGPSHPSHMEEPFLQMVQASESLPPSQTWAQREFFLPSESWEFPGFTRQAYHQLALKLPPCTDMKSKVRQRLIHPWKGGAQHTWGFHTWLDVCRLPATFPTQPDRPYDSNVWRWLTDSNAHRCPPTEHPIPPPSWMGQNSFLTFIHCYPTFVDMKRKKQVIFRTVKELKEVEKLKLRSEARAPPLDAQGNIQPPASFKKYRHISAGGRFEPQGLQLMPNPFPNNFARSWPCPNPLPHYQEKVLKLALLPSAPLSQDLIRDFQTLIKDRTALPLHHLSKAQASKSPARKRKRRPGHF

SEQ ID NO: 30896 - protein, 305 aa, Homo sapiens; identical to SEQ ID NO: 30895
  ENSP00000489863

SEQ ID NO: 30897 - protein, 220 aa, Homo sapiens
  ENSP00000490515
MFQLLIPLLLALKGHAQDNPENVQCGHRPAFPNSSWLPFHERLQVQNGECPWQVSIQMSRKHLCGGSILHWWWVLTAAHCFRRTLLDMAVVNVTVVMGTRTFSNIHSERKQVQKEEERTWDWCWMAQWVTTNGYDQYDDLNMHLEKLRVVQISRKECAKRINQLSRNMICAWNEPGTNGIFKVLTPAQPPPPSRETVGHLWFVLFMEPRDSSKWVSSVGA

SEQ ID NO: 30898 - protein, 133 aa, Homo sapiens
  ENSP00000490582
MAVVNVTVVMGTRTFSNIHSERKQVQKEEERTWDWCWMAQWVTTNGYDQYDDLNMHLEKLRVVQISRKECAKRINQLSRNMICAWNEPGTNGIFKVLTPAQPPPPSRETVGHLWFVLFMEPRDSSKWVSSVGA

SEQ ID NO: 30899 - protein, 79 aa, Homo sapiens
  ENSP00000421046
  MOD_RES (1)..(1): Any amino acid
XSDDTTTWNSCLPPPVNQGRHYQKEMNPPSPSNPRDWLNMLSPPIVPPSQQPAEQRPDSCESLSVQEEMSGSATAILQL

SEQ ID NO: 30900 - protein, 26 aa, Homo sapiens
  ENSP00000419245
  MOD_RES (1)..(1): Any amino acid
XPPIVPPSQQPAEQRPDSCESLSVQG

SEQ ID NO: 30901 - protein, 186 aa, Homo sapiens
  ENSP00000419949
NNFEMSLLPTTCLSPTGRRCGSCQKTPEPVIKAKDLSAQQVPASLNKTSLKEISGERLSSIPEASEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQG

SEQ ID NO: 30902 - protein, 44 aa, Homo sapiens
  ENSP00000417917
  MOD_RES (1)..(1): Any amino acid
XDWLNMLSPPIVPPSQQPAEQRPDSCESLSVQDISHTPDQAVTR

SEQ ID NO: 30903 - protein, 563 aa, Homo sapiens
  ENSP00000295966
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 30904 - protein, 689 aa, Homo sapiens
  ENSP00000417122
MIKRKIWCNLCIDLVAFTSEIFKGAVFQSLDGIVVSANCKLRKIFTLKSKPQDTADKDAVYGVPFSTDEPTDIIPRSCQLMTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHAANLHIMHPHPPQEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEGNHSIQGSRGPTTGPSELTQLTLESLLGKAAKRTSKEYLRSAYTEAGATESQDSSMEQIDRNNFEMSLLPTTCLSPTGRRCGSCQKTPEPVIKAKDLSAQQVPASLNKTSLKEISGERLSSIPEASEYDWRNYQPSQMSESELQMLASLRWQQNEELEDAGTSHGLSASQVDNCNVSISTSSDDTTTWNSCLPPPVNQGRHYQKEMNPPSPSNPRDWLNMLSPPIVPPSQQPAEQRPDSCESLSVQGEEDLSVEEDEEVLTLLYDPCLNCYFDPQTGKYYELV

SEQ ID NO: 30905 - protein, 196 aa, Homo sapiens
  ENSP00000419142
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKLRKIFTLKSKPQDTADKDGMFSCLWCSLFNR

SEQ ID NO: 30906 - protein, 40 aa, Homo sapiens
  ENSP00000417881
SISTSSDDTTTWNSCLPPPVNQGRHYQKEMNPPSPSNPRL

SEQ ID NO: 30907 - protein, 334 aa, Homo sapiens
  ENSP00000417271
MTDVPHVTQLLNMTKLRQTEIKFGGHPLRSAESDQFINRGTSITRNSKNQDVCHIAFGSKVLGPPPLSGRRNNMKISSETVRSVGSKNNRSCQPSTVEKCVNGTEMSALLIPESEEQGNKENIHQIKQTVPIHEPSADKNNNRRRLRLKSTSRERTETPSGSSSGNNRIEDKASTILTTVSQQGAELLNSGTLGPQSPDQSDEWIFPENADHISYLASSRQSLLLGDDSCNPSHLWLEASKESEHDQQAEESQSVPKDIFTFSSRPRSAPHGKTQTMSPEELSFILDLKEDNSVTSRDTQSEDDFYGGDSSEEVHCLISEVVLKHSCFLSSNKH

SEQ ID NO: 30908 - protein, 191 aa, Homo sapiens
  ENSP00000419028
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKLRKIFTLKSKPQDTADKDGNSAPWNS

SEQ ID NO: 30909 - protein, 74 aa, Homo sapiens
  ENSP00000418832
MIKRKIWCNLCIDLVAFTSEIFKGAVFQSLDGIVVSANCKLRKIFTLKSKPQDTADKDGMFRLLSRFFNSLMYF

SEQ ID NO: 30910 - protein, 166 aa, Homo sapiens
  ENSP00000417639
MFKNEYQGGAFVEIFSAQGKNPGAKWKILGSPSVIWKEFDKEVKSFVFVLEGSSQTNKIQLPKENKQSLGLIQRFLVLQIYVPLGQDFSTELLITDLGNIKRRLYLSTVHKELSSTPLHAKIPLFMIKRKIWCNLCIDLVAFTSEIFKGAVFQSLDGIVVSANCKL

SEQ ID NO: 30911 - protein, 282 aa, Homo sapiens
  ENSP00000383226
MAASTMSVCSSACSDSWQVDACPESCCEPHCCALSCCAPAPCLTLVCTPVSRVSSPCCQAACEPSPCQSGCTSSCTPSCCQQSSCQPACCTSSPCQQACCVPVCCKPVCCLPTCSKDSSSCCQQSSCQPTCCASSSSQQSCCVPVCCKPVCYVPTCSEDSSSCCQQSSCHPACCTSSPCQQACCVPVRCKPVCCKPICCVPVCSGASTSCCQQSSCQPACCTTSCCRPSSSVSLLCRPVCRPACCMPVSSCCAPASSCQASCCRPASCVSLLCRPACSRPAC

SEQ ID NO: 30912 - protein, 251 aa, Homo sapiens
  ENSP00000369438
MAASTMSICSSACTDSWRVVDCPESCCEPCCCAPAPSLTLVCTPVSCVSSPCCQTACEPSACQSGYTSSCTTPCYQQSSCQPDCCTSSPCQQACCVPVCCVPVCCVPVCNKPVCFVPTCSESSPSCCQQSSCQPTCCTSSPCQQACCVPVCSKSVCYVPVCSGASTSCCQQSSCQPACCTASCCRPSSSVSLLCHPVCKSTCCVPVPSCGASASSCQPSCCRTASCVSLLCRPVCSRPACYSLCSGQKSSC

SEQ ID NO: 30913 - protein, 298 aa, Homo sapiens
  ENSP00000334197
MAASTMSVCSSAYSDSWQVDDCPESCCEPPCSAPSCCAPAPSLSLVCTPVSCVSSPCCQAACEPSACQSGCTSSCTPSCCQQSSCQPACCTSSPCQQACCVPVCCKTVCCKPVCCVPVCCGAASSCCRQSSCQPACCASSSCQPACCVPVCCKPVCCVSTCSEDSSSCCQQSSCQPACCTSSSYQQACCVPVCCKTVYCKPICCVPVCSRASSSRCQQPSCQPACCTTSCCRPSSSVSLLCHPVCRSTCCVPVSSCCAPTSSCQSSCCRPASCVSLLCRPASSRLACYSLCSGKKSSC

SEQ ID NO: 30914 - protein, 245 aa, Homo sapiens
  ENSP00000383216
MSVCSSDLSYGSRVCLPGSCDSCSDSWQVDDCPESCCEPPCCAPAPCLSLVCTPVSRVSSPCCRVTCEPSPCQSGCTSSCTPSCCQQSSCQPACCTSSPCQQACCVPVCCKTVCCKPVCCMPVCCGPSSSCCQQSSCQPACCISSPCQQSCCVPVCCKPICCVPVCSGASSLCCQQSSCQPACCTTSCCRPSSSVSLLCRPVCRPARRVPVPSCCVPTSSCQPSCGRLASCGSLLCRPTCSRLAC

SEQ ID NO: 30915 - protein, 94 aa, Homo sapiens
  ENSP00000482575
CTSSCTPSCCQQSSCQPACCTSSPCQQACCVPVCCKTVCCKPSSCQPACCISSPCQQSCCVPVCCKPICCVPPACCTTSCCRPSSSVSLLCRPV

SEQ ID NO: 30916 - protein, 255 aa, Homo sapiens
  ENSP00000375479
MAASTMSICSSACTNSWQVDDCPESCCELPCGTPSCCAPAPCLTLVCTPVSCVSSPCCQAACEPSACQSGCTSSCTPSCCQQSSCQPACCTSSPCQQACCVPVCCKPVCCVPVCCGASSCCQQSSCQPACCASSSCQQSCRVPVCCKAVCCVPTCSESSSSCCQQSSCQPACCTSSPCQQSCCVSVCCKPVCCKSICCVPVCSGASSPCCQQSSCQPACCTSSCCRPSSSVSLLCRPVCSRPASCSFSSGQKSSC

SEQ ID NO: 30917 - protein, 221 aa, Homo sapiens
  ENSP00000375478
MATSTMSVCSSAYSDSWQVDACPESCCEPPCCATSCCAPAPCLTLVCTPVSCVSSPCCQAACEPSPCQSGCTSSCTPSCCQQSSCQPACCTSSPCQQACCVPVCCKPVCCVPVCCKPVCCKPICCVPVCSGASSSCCQQSSRQPACCTTSCCRPSSSVSLLCRPVCRSTCCVPIPSCCAPASTCQPSCCRPASCVSLLCRPTCSRLSSACCGLSSGQKSSC

SEQ ID NO: 30918 - protein, 401 aa, Homo sapiens
  ENSP00000383225
MSVCSSDLSYSSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCVPVCCKTVCCKPVCCVPVCCGDSSCCQQSSCQSACCTSSPCQQACCVPICCKPVCSGISSSCCQQSSCVSCVSSPCCQAVCEPSPCQSGCISSCTPSCCQQSSCQPACCTSSSCQQACCVPVCCKTVCCKPVCSEDSSSCCQQSSCQPACCTSSPCQQACCVPVCCKPVCCKPVCSVPICSGASSLCCQQSSCQPACCTSSQSQQGCCVPVCCKPVSCVPVCSGASSSCCQQSSCQPACCTTSCCRPSSSVSLLCRPVCRPACCVPVPSCCAPTSSCQPSCCRPASCVSLL

SEQ ID NO: 30919 - protein, 370 aa, Homo sapiens
  ENSP00000484068
TAASTMSVCSSDLSYSSRVCLPGSCDSCSDSWQVDDCPESCCEPPCCAPSCCAPAPCLSLVCTPVSRVSSPCCPVTCEPSPCQSGCTSSCTPSCCQQSSCQLACCASSPCQQACCVPVCCKTVCCKPVCCVPVCCGDSSCCQQSSCQSACCTSSPCQQACCVPICCKPVCSGISSSCCQQSSCVSCVSSPCCQAVCEPSPCQSGCISSCTPSCCQQSSCQPACCTSSSCQQACCVPVCCLPVCCAPTCSEDSYSCCQQSSCQPACCTSSPCQQACCVPVCSGASTSCCQQSSCQPACCTASCCRPSSSVSLLCHPVCKSTCCVPVPSCGASASSCQPSCCRTASCVSLLCRPVCSRPACYSLCSGQKSSC

SEQ ID NO: 30920 - protein, 198 aa, Homo sapiens
  ENSP00000481165
AASTMSVCSSSCSDSWQVDDCPESCCEPPCCAPSCCAPAPCLSLVCTPVSRVSSPCCPVTCEPSPCQSGCTSSCTPSCCQQSSCQPACCTSSPCQQACCVPVCCKPVCCKPVCCCVPVCCKPVSCVPVCSGASSSCCQQSSCQPACCTTSCCRPSSSVSLLCRPVCRPACCVPVPSCCAPTSSCQPSCCRPASCVSLL

SEQ ID NO: 30921 - protein, 271 aa, Homo sapiens
  ENSP00000383223
MAACTMSVCSSACSDSWRVDDCPESCCEPPCGTAPCLTLVCTPVSCVSSPCCQAACEPSPCQSGCTSSCTPSCCQPACCASSPCQQACCVPVCCKPVCCLPTCSKDSSSCCQQSSCQPTCCASSSCQQSCCVPVCCKPVCCVPTCSEDSSSCCQHSSCQPTCCTSSPCQQSCYVPVCCKPVCCKPICCVPVCSGASTSCCQQSSCQPACCTTSCCRPSSSVSLLCRPICRPACCLPISSCCAPASSYQASCCRPASCVSLLCRPACSPLAC

SEQ ID NO: 30922 - protein, 365 aa, Homo sapiens
  ENSP00000383219
MAASTMSVCSSDLSYGSRVCLPGSCDSCSDSWQVDDCPESCCEPPCCAPAPCLSLVCTPVSRVSSPCCPVTCEPSPCQSGCTSSCTPSCCQQSSCQLACCASSPCQQACCVPVCCKTVCCKPVCCVSVCCGDSSCCQQSSCQSACCTSSPCQQACCVPVCCKPVCSGISSSCCQQSSCVSCVSSPCCQAVCEPSPCQSGCTSSCTPSCCQQSSCQPTCCTSSPCQQACCVPVCCVPVCCVPTCSEDSSSCCQQSSCQPACCTSSPCQHACCVPVCSGASTSCCQQSSCQPACCTASCCRSSSSVSLLCHPVCKSTCCVPVPSCGASASSCQPSCCRTASCVSLLCRPMCSRPACYSLCSGQKSSC

SEQ ID NO: 30923 - protein, 370 aa, Homo sapiens
  ENSP00000476821
MAASTMSVCSSDLSYGSRVCLPGSCDSCSDSWQVDDCPESCCEPPCCAPAPCLSLVCTPVSYVSSPCCRVTCEPSPCQSGCTSSCTPSCCQQSSCQLACCASSPCQQACCVPVCCKTVCCKPVYCVPVCSGDSSCCQQSSCQSACCTSSPCQQACCVPICCKPVCSGISSSCCQQSSCVSCVSSPCCQAVCEPSPCQSGCISSCTPSCCQQSSCKPACCTSSPCQQACCVPVCCKPVCCVPTCSDDSGSCCQPACCTSSQSQQGCCVPVCCKPVCCVPVCSGASTSCCQQSSCQPACCTTSCCRPSSSVSLLCRPVCRPACCVPVPSCCAPTSSCQASCCRPASCVSLLCRPACSRPACCGPTSTQKSSC

SEQ ID NO: 30924 - protein, 259 aa, Homo sapiens
  ENSP00000335565
MADACCTRTYVIAASTMSVCSSDVGHVSRVSSPSTCTGSSWQVDNCQESCCEPRSCASSCCTPSCCAPAPCLALVCAPVSCEPSPCQSGCTDSCTPSCCQQSSCQPACCTSSPCQQACCVPVCCKSNCCKPVCCVSICSGASSPCCQQSSCQSACCTFSPCQQACCVPICCKPICCVPVCSGASSLCCQKSSCQPACCTTSCCRPSSSVSLLCRPVCRPACCVPVPSCCVPASSCQPSCCHPASCLSFLCRPACSRLAC

SEQ ID NO: 30925 - protein, 292 aa, Homo sapiens
  ENSP00000381009
MAASTMSIRSSAYSDSWQVDDCPESCCEPPCCATSCCAPAPCLTLVCTPVSRVSSPCCQVTCEPSPCQSGCTSSCTPSCCQQSSCQPAYCTSSPCQQACCVPVCCKPVCCVPVCCGASSCCQQSSYQPACCASSSCQPACCVPVCCKPVCCAPTCSEDSYSCCQQSSCQPACCTSSPCQQSYCVPVCCKPVCCKPICCVPVCSGASSLCCQQSGCQPACCTTSCCRPSSSVSLLCRPVCRPACCVPVSSCCAPTSSRQPSYCRQASCVSLLCRPVCSRPACYSFSSGQKSSC

SEQ ID NO: 30926 - protein, 192 aa, Homo sapiens [sequence omitted]

SEQ ID NO: 30927 - protein, 754 aa, Homo sapiens
  ENSP00000377086
MSPEPVPPPPPPQCPGCDRAEPIAQRLEEGDEAFRAGDYEMAAELFRSMLAGLAQPDRGLCLRLGDALARAGRLPEALGAFRGAARLGALRPEELEELAGGLVRAVGLRDRPLSAENPGGEPEAPGEGGPAPEPRAPRDLLGCPRCRRLLHKPVTLPCGLTVCKRCVEPGPARPQVRRVNVVLSGLLEKCFPAECRLRRLAGQARSLQRQQQPEAALLRCDQALELAPDDNSLLLLRAELYLTMKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 30928 - protein, 511 aa, Homo sapiens
  ENSP00000386823
MKNYEQALQDASAACQNEPLLIKGHQVKAQALSGLGRSKEVLKEFLYCLALNPECNSVKKEAQKVMCEVLFSATANVHENLTSSIQSRLKAQGHSHMNAQALLEEGDAGSSENSSEKSDMLGNTNSSVLYFILGLHFEEDKKALESILPTAPSAGLKRQFPDDVEDAPDLNAPGKIPKKDLSLQRSPNSETEESQGLSLDVTDFECALCMRLLFEPVTTPCGHTFCLKCLERCLDHAPHCPLCKDKLSELLASRNFNITVLAEELIFRYLPDELSDRKRIYDEEMSELSNLTRDVPIFVCAMAFPTVPCPLHVFEPRYRLMIRRCMETGTKRFGMCLSAEHAGLSEYGCMLEIKDVRTFPDGSSVVDAIGISRFRVLSHRHRDGYNTADIEYLEDEKVEGPEYEELAALHDSVHQQSVSWFASLQDRMKEQILSHFGVMPDREPEPQSNPSGPAWSWWILAVLPLERKAQLAILGMTSLKERLLAIRRILVIITRKMNSRQELANARERNN

SEQ ID NO: 30929 - protein, 774 aa, Homo sapiens
  ENSP00000373783
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 30930 - protein, 101 aa, Homo sapiens
  ENSP00000473322
MERPLCSHLCSCLAMLALLSPLSLAQYDSWPHYPEYFQQPAPEYHQPQAPANVAKIQLHLVLARRCQQQQSGHEWSEVLGNGAVPGALPPRRGGRGLPPGR

SEQ ID NO: 30931 - protein, 207 aa, Homo sapiens
  ENSP00000427907
  MOD_RES (1)..(1): Any amino acid
XENGLPAVVSCVPGQVFSPDGPSRFRKAYKPEQDRVSLQQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQ

SEQ ID NO: 30932 - protein, 67 aa, Homo sapiens
  ENSP00000427826
RIRAILSTYRKRTPVMEGYVEVKEGKTWKQICDKHWTAKNSRVVCGMFGFPGERTYNTKVYNNPWCD

SEQ ID NO: 30933 - protein, 258 aa, Homo sapiens
  ENSP00000427883
MEASKVLDKSKAAAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 30934 - protein, 218 aa, Homo sapiens
  ENSP00000429778
MEASKVLDKSKAAESSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 30935 - protein, 151 aa, Homo sapiens
  ENSP00000430519
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHT

SEQ ID NO: 30936 - protein, 139 aa, Homo sapiens
  ENSP00000428497
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACT

SEQ ID NO: 30937 - protein, 95 aa, Homo sapiens
  ENSP00000428933
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHV

SEQ ID NO: 30938 - protein, 364 aa, Homo sapiens
  ENSP00000363553
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 30939 - protein, 364 aa, Homo sapiens; identical to SEQ ID NO: 30938
  ENSP00000363552

SEQ ID NO: 30940 - protein, 364 aa, Homo sapiens; identical to SEQ ID NO: 30938
  ENSP00000351755

SEQ ID NO: 30941 - protein, 182 aa, Homo sapiens
  ENSP00000401810
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIP

SEQ ID NO: 30942 - protein, 346 aa, Homo sapiens
  ENSP00000445697
MNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 30943 - protein, 544 aa, Homo sapiens
  ENSP00000262134
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 30944 - protein, 188 aa, Homo sapiens
  ENSP00000457496
  MOD_RES (1)..(1): Any amino acid
XAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEMFLFFWEGSSKHCLKISSFFCIFSLRRFKRRITQRTRTAHLLRLSF

SEQ ID NO: 30945 - protein, 524 aa, Homo sapiens
  ENSP00000317300
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 30946 - protein, 84 aa, Homo sapiens
  ENSP00000454422
FLPVYHPSPEESRDPTLYANNVQRVMAQALGIPATECEFVGSLPVIVVGRLKVALEPQLWELGKVLRKAGIPRVWWTSEMWPLH

SEQ ID NO: 30947 - protein, 351 aa, Homo sapiens
  ENSP00000478003
MTRLLDAEWWRRSEAGHLRRQVAAVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 30948 - protein, 115 aa, Homo sapiens
  ENSP00000428496
MVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEY

SEQ ID NO: 30949 - protein, 129 aa, Homo sapiens
  ENSP00000428237
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTK

SEQ ID NO: 30950 - protein, 105 aa, Homo sapiens
  ENSP00000428557
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPD

SEQ ID NO: 30951 - protein, 475 aa, Homo sapiens
  ENSP00000309757
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 30952 - protein, 39 aa, Homo sapiens
  ENSP00000431028
MESKALLVLTLAVWLQSLTASRGGVAAADLILKLQIFKF

SEQ ID NO: 30953 - protein, 428 aa, Homo sapiens
  ENSP00000393602
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGEWGLELTSEVTILL

SEQ ID NO: 30954 - protein, 151 aa, Homo sapiens
  ENSP00000410340
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTAS

SEQ ID NO: 30955 - protein, 52 aa, Homo sapiens
  ENSP00000397166
MSHPSWLPPKSTGEPLGHVPARMETTHSFGNPSISVSTQQPPKKFAPVVAPK

SEQ ID NO: 30956 - protein, 93 aa, Homo sapiens
  ENSP00000392667
MSHPSWLPPKSTGEPLGHVPARMETTHSFGNPSISVSTQQPPKKFAPVVAPKPKYNPYKQPGGEGDFLPPPPPPLDDSSALPSISGNFPPPPP

SEQ ID NO: 30957 - protein, 65 aa, Homo sapiens
  ENSP00000394257
MSHPSWLPPKSTGEPLGHVPARMETTHSFGNPSISVSTQQPPKKFAPVVAPKPKYNPYKQPGGEG

SEQ ID NO: 30958 - protein, 66 aa, Homo sapiens
  ENSP00000397017
MSHPSWLPPKSTGEPLGHVPARMETTHSFGNPSISVSTQQPPKKFAPVVAPKPKYNPYKQPGGEGD

SEQ ID NO: 30959 - protein, 111 aa, Homo sapiens
  ENSP00000405138
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLE

SEQ ID NO: 30960 - protein, 46 aa, Homo sapiens
  ENSP00000404679
MSHPSWLPPKSTGEPLGHVPARMETTHSFGNPSISVSTQQPPKKFA

SEQ ID NO: 30961 - protein, 590 aa, Homo sapiens
  ENSP00000482617
METTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 30962 - protein, 57 aa, Homo sapiens
  ENSP00000403825
MSHPSWLPPKSTGEPLGHVPARMETTHSFGNPSISVSTQQPPKKFAPVVAPKPKYNP

SEQ ID NO: 30963 - protein, 252 aa, Homo sapiens
  ENSP00000393008
MVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFEC

SEQ ID NO: 30964 - protein, 612 aa, Homo sapiens
  ENSP00000491657
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 30965 - protein, 612 aa, Homo sapiens; identical to SEQ ID NO: 30964
  ENSP00000478901

SEQ ID NO: 30966 - protein, 696 aa, Homo sapiens
  ENSP00000308493
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEEKLCLPHHILEEKGLVKVGITIQALLDITVTKALFT

SEQ ID NO: 30967 - protein, 728 aa, Homo sapiens
  ENSP00000374448
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 30968 - protein, 763 aa, Homo sapiens
  ENSP00000374447
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSDPALILPPISFNTLTQAQTWDSSSYSVPSEGDSDNVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 30969 - protein, 98 aa, Homo sapiens
  ENSP00000417121
MKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMS

SEQ ID NO: 30970 - protein, 72 aa, Homo sapiens
  ENSP00000419256
MKQLQVLLLENNPLQSPPAQICTKGKVHIFKYLSIQACQIKTADSLYLHTMERPHLHQHVEDGKKDSDSGVG

SEQ ID NO: 30971 - protein, 1093 aa, Homo sapiens
  ENSP00000273261
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 30972 - protein, 1070 aa, Homo sapiens
  ENSP00000373208
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLLLLEPSQSAGCSSPSQPHMSAGGRTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAAQTPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 30973 - protein, 1093 aa, Homo sapiens; identical to SEQ ID NO: 30971
  ENSP00000488729

SEQ ID NO: 30974 - protein, 1070 aa, Homo sapiens; identical to SEQ ID NO: 30972
  ENSP00000488182

SEQ ID NO: 30975 - protein, 296 aa, Homo sapiens
  ENSP00000451449
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHRRSRKRAQENEVTQHG

SEQ ID NO: 30976 - protein, 4544 aa, Homo sapiens
  ENSP00000243077
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 30977 - protein, 292 aa, Homo sapiens
  ENSP00000341264
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHLCVFSKSQQEMG

SEQ ID NO: 30978 - protein, 439 aa, Homo sapiens
  ENSP00000451737
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILVRELLSEVLWGNHDPGPSGEGGSLCRGTVL

SEQ ID NO: 30979 - protein, 139 aa, Homo sapiens
  ENSP00000451622
  MOD_RES (1)..(1): Any amino acid
XRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVNSLHAESTTVAARTCVCSLTRAMSTAHAEGAESSRMTSPA

SEQ ID NO: 30980 - protein, 183 aa, Homo sapiens
  ENSP00000451012
NGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECGEPRPHSRRKTVYLDERTCEPYQFRCKNNRCVPGRWQCDYDNDCGDNSDEESCTPRPCSESEFSCANGRCIAGRWKCDGDHDCAD

SEQ ID NO: 30981 - protein, 4599 aa, Homo sapiens
  ENSP00000374135
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 30982 - protein, 798 aa, Homo sapiens
  ENSP00000415052
  MOD_RES (1)..(1): Any amino acid
XSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKPTNYSNPVYAKLYMDGQNCRNSLGSVDERKELLPKKIEIGIRETVA

SEQ ID NO: 30983 - protein, 280 aa, Homo sapiens
  ENSP00000393859
  MOD_RES (1)..(1): Any amino acid
XRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSVGFKSQRCDQKENPCDHYCQNEGICTLTAFNEPRCKCSTNWSGTQCERPAPKSSKSDHISTRSIAIIVPLVLLVTLITTLVIGLVLCKRKRRTKTIRRQPIINGGINVEIGNPSYNMYEVDHDHNDGGLL

SEQ ID NO: 30984 - protein, 781 aa, Homo sapiens
  ENSP00000413239
MSEFLLALLTLSGLLPIARVLTVGADRDQQLCDPGEFLCHDHVTCVSQSWLCDGDPDCPDDSDESLDTSRTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFIN

SEQ ID NO: 30985 - protein, 4655 aa, Homo sapiens
  ENSP00000263816
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 30986 - protein, 1225 aa, Homo sapiens
  ENSP00000409813
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCSKFPDHSLLAINSF

SEQ ID NO: 30987 - protein, 357 aa, Homo sapiens
  ENSP00000421922
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 30988 - protein, 105 aa, Homo sapiens
  ENSP00000421648
MAPRRVRSFLRGLPALLLLLLFLGPWPAASHGGKYSREKNQPKPSPKRESGEEFRMEKLNQLWEKAQRNLPVASLLRGQFLAVSWSVLLVAHRLLPFVRSCIFLP

SEQ ID NO: 30989 - protein, 197 aa, Homo sapiens
  ENSP00000435217
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLNQLEPSYI

SEQ ID NO: 30990 - protein, 524 aa, Homo sapiens
  ENSP00000359925
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLPESIGALLHLKDLWLDGNQLSELPQEIGNLKNLLCLDVSENRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 30991 - protein, 154 aa, Homo sapiens
  ENSP00000359919
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGKQKTTS

SEQ ID NO: 30992 - protein, 371 aa, Homo sapiens
  ENSP00000379241
MGHKVVVFDISVIRALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQAMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 30993 - protein, 371 aa, Homo sapiens; identical to SEQ ID NO: 30992
  ENSP00000296144

SEQ ID NO: 30994 - protein, 184 aa, Homo sapiens
  ENSP00000348043
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 30995 - protein, 184 aa, Homo sapiens; identical to SEQ ID NO: 30994
  ENSP00000362321

SEQ ID NO: 30996 - protein, 134 aa, Homo sapiens
  ENSP00000350860
MLKKMGEAVARVARKVNETVESGSDTLELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 30997 - protein, 128 aa, Homo sapiens
  ENSP00000350255
MLKKMGEAVARVARKVNETVESGSDTLDLAECKLVSFPIGIYKVLRNVSGQIHLITLANNELKSLTSKFMTTFSQLRDVPVEKLAAMPALRSINLRFNPLNAEVRVIAPPLIKFDMLMSPEGARAPLP

SEQ ID NO: 30998 - protein, 174 aa, Homo sapiens
  ENSP00000413745
MLKKMGEAVARVARKVNETVESGSDTLDLAECKLVSFPIGIYKVLRNVSGQIHLITLANNELKSLTSKFMTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLM

SEQ ID NO: 30999 - protein, 134 aa, Homo sapiens; identical to SEQ ID NO: 30996
  ENSP00000378458

SEQ ID NO: 31000 - protein, 115 aa, Homo sapiens
  ENSP00000378457
MTTFSQLRELHLEGNFLHRLPSEVSALQHLKAIDLSRNQFQDFPEQLTALPALETINLEENEIVDVPVEKLAAMPALRSINLRFNPLNAEVRVIAPPLIKFDMLMSPEGARAPLP

SEQ ID NO: 31001 - protein, 294 aa, Homo sapiens
  ENSP00000365253
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLCIIIFSGVAVSIAAIISSFFLATVVQCLQRCAPNKDAEDEDEDKDD

SEQ ID NO: 31002 - protein, 259 aa, Homo sapiens
  ENSP00000379880
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 31003 - protein, 54 aa, Homo sapiens
  ENSP00000389764
MNLVDLWLTRSLSMCLLLQSFVLMILCFHSASMCPKGCLCSSSGGLNVTCSNAN

SEQ ID NO: 31004 - protein, 163 aa, Homo sapiens
  ENSP00000398184
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASN

SEQ ID NO: 31005 - protein, 259 aa, Homo sapiens; identical to SEQ ID NO: 31002
  ENSP00000406370

SEQ ID NO: 31006 - protein, 259 aa, Homo sapiens; identical to SEQ ID NO: 31002
  ENSP00000394940

SEQ ID NO: 31007 - protein, 640 aa, Homo sapiens
  ENSP00000278198
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 31008 - protein, 640 aa, Homo sapiens; identical to SEQ ID NO: 31007
  ENSP00000436976

SEQ ID NO: 31009 - protein, 640 aa, Homo sapiens; identical to SEQ ID NO: 31007
  ENSP00000437132

SEQ ID NO: 31010 - protein, 640 aa, Homo sapiens; identical to SEQ ID NO: 31007
  ENSP00000434761

SEQ ID NO: 31011 - protein, 41 aa, Homo sapiens
  ENSP00000431363
MLNKMTLHPQQIMIGPRFNRALFDPLLVVLLALQLLVVAGL

SEQ ID NO: 31012 - protein, 640 aa, Homo sapiens; identical to SEQ ID NO: 31007
  ENSP00000480903

SEQ ID NO: 31013 - protein, 50 aa, Homo sapiens
  ENSP00000428285
MTERLLIKALSGGKNTKIITLNGKKMTKMPSALGKLPGLKTLVLQNNLIP

SEQ ID NO: 31014 - protein, 69 aa, Homo sapiens
  ENSP00000428537
MTERLLIKALSGGKNTKIITLNGKKMTKMPSALGKLPGLKTLVLQNNLIPKVCPELCNLTQAGCGGSCL

SEQ ID NO: 31015 - protein, 191 aa, Homo sapiens
  ENSP00000343221
MTERLLIKALSGGKNTKIITLNGKKMTKMPSALGKLPGLKTLVLQNNLIPKVCPELCNLTQFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 31016 - protein, 347 aa, Homo sapiens
  ENSP00000400803
MTERLLIKALSGGKNTKIITLNGKKMTKMPSALGKLPGLKTLVLQNNLIPKVCPELCNLTQLTTLNLGNNLLEEVPEEMKYLTSLKNLHLSGNRICRFAPGACDGLQNLILLNLNNNHLTQLPQEVSRLKSLTYMSINYNQLASIPRELCFLENLVELQLNYNQLICIPEEIKFLKKLQKLLLARNNIGVLPEELCDLKKLRILDIAGNIIQIFPSGFQDLKLREFYCEGNPLFLQQPVISTQQENVWSLQEITSRFVMNQLAENNPFLMDDIERYPQVRSMISQGKTCAICGQYFITVWLECVRFVPPPKDWKISKNLKLVPLQVLICSYKCFTQRDPNLFGIAQV

SEQ ID NO: 31017 - protein, 1495 aa, Homo sapiens
  ENSP00000309245
MQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 31018 - protein, 217 aa, Homo sapiens
  ENSP00000359997
MMENLIRGRNPPQYQRSPCKEVRAALRKRPEEELQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPNI

SEQ ID NO: 31019 - protein, 1537 aa, Homo sapiens
  ENSP00000035383
MTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 31020 - protein, 61 aa, Homo sapiens
  ENSP00000466082
  MOD_RES (1)..(1): Any amino acid
XGIFVTRVQPDGPASNLLQPGDKILQANGHSFVHMEHEKAVLLLKSFQNTVDLVIQRKHLL

SEQ ID NO: 31021 - protein, 36 aa, Homo sapiens
  ENSP00000476660
  MOD_RES (1)..(1): Any amino acid
XANGHSFVHMEHEKAVLLLKSFQNTVDLVIQRKHLL

SEQ ID NO: 31022 - protein, 32 aa, Homo sapiens
  ENSP00000476307
  MOD_RES (1)..(1): Any amino acid
XSFVHMEHEKAVLLLKSFQNTVDLVIQRKHLL

SEQ ID NO: 31023 - protein, 25 aa, Homo sapiens
  ENSP00000477399
  MOD_RES (1)..(1): Any amino acid
XEKAVLLLKSFQNTVDLVIQRKHLL

SEQ ID NO: 31024 - protein, 821 aa, Homo sapiens
  ENSP00000394867
MTKMLGKLRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 31025 - protein, 521 aa, Homo sapiens
  ENSP00000398726
MRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERGNNVEVLMSGNVRCYNIVVEAMKAFPMSERIQEVSCCLLHRLTLGNFFNILVLNEVHEFVVKAVQQYPENAALQISALSCLALLRSFPGICECIVNSLRTKCNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRK

SEQ ID NO: 31026 - protein, 1271 aa, Homo sapiens
  ENSP00000341930
MASGSCQGCEEDEETLKKLIVRLNNVQEGKQIETLVQILEDLLVFTYSERASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSALTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEVRRLLPLKKYTL

SEQ ID NO: 31027 - protein, 2527 aa, Homo sapiens
  ENSP00000298910
MASGSCQGCEEDEETLKKLIVRLNNVQEGKQIETLVQILEDLLVFTYSERASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSALTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEIPPEIGCLENLTSLDVSYNLELRSFPNEMGKLSKIWDLPLDELHLNFDFKHIGCKAKDIIRFLQQRLKKAVPYNRMKLMIVGNTGSGKTTLLQQLMKTKKSDLGMQSATVGIDVKDWPIQIRDKRKRDLVLNVWDFAGREEFYSTHPHFMTQRALYLAVYDLSKGQAEVDAMKPWLFNIKARASSSPVILVGTHLDVSDEKQRKACMSKITKELLNKRGFPAIRDYHFVNATEESDALAKLRKTIINESLNFKIRDQLVVGQLIPDCYVELEKIILSERKNVPIEFPVIDRKRLLQLVRENQLQLDENELPHAVHFLNESGVLLHFQDPALQLSDLYFVEPKWLCKIMAQILTVKVEGCPKHPKGIISRRDVEKFLSKKRKFPKNYMSQYFKLLEKFQIALPIGEEYLLVPSSLSDHRPVIELPHCENSEIIIRLYEMPYFPMGFWSRLINRLLEISPYMLSGRERALRPNRMYWRQGIYLNWSPEAYCLVGSEVLDNHPESFLKITVPSCRKGCILLGQVVDHIDSLMEEWFPGLLEIDICGEGETLLKKWALYSFNDGEEHQKILLDDLMKKAEEGDLLVNPDQPRLTIPISQIAPDLILADLPRNIMLNNDELEFEQAPEFLLGDGSFGSVYRAAYEGEEVAVKIFNKHTSLRLLRQELVVLCHLHHPSLISLLAAGIRPRMLVMELASKGSLDRLLQQDKASLTRTLQHRIALHVADGLRYLHSAMIIYRDLKPHNVLLFTLYPNAAIIAKIADYGIAQYCCRMGIKTSEGTPGFRAPEVARGNVIYNQQADVYSFGLLLYDILTTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEEVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVMVKENKESKHKMSYSGRVKTLCLQKNTALWIGTGGGHILLLDLSTRRLIRVIYNFCNSVRVMMTAQLGSLKNVMLVLGYNRKNTEGTQKQKEIQSCLTVWDINLPHEVQNLEKHIEVRKELAEKMRRTSVE

SEQ ID NO: 31028 - protein, 207 aa, Homo sapiens
  ENSP00000410821
  MOD_RES (1)..(1): Any amino acid
XLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLVSGCSVVPQGNLIQTVESGKHFCACDI

SEQ ID NO: 31029 - protein, 454 aa, Homo sapiens
  ENSP00000490200
  MOD_RES (1)..(1): Any amino acid
XTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEEVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVMVKENKESKHKMSYSGRVKTLCLQKNTALWIGTGGGHILLLDLSTRRLIRVIYNFCNSVRVMMTAQLGSLKNVMLVLGYNRKNTEEIQSCLTVWDINLPHEVQNLEKHIEVRKELAEKMRRTSVE

SEQ ID NO: 31030 - protein, 591 aa, Homo sapiens
  ENSP00000387228
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 31031 - protein, 590 aa, Homo sapiens
  ENSP00000387297
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 31032 - protein, 590 aa, Homo sapiens; identical to SEQ ID NO: 31031
  ENSP00000386357

SEQ ID NO: 31033 - protein, 518 aa, Homo sapiens
  ENSP00000386236
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 31034 - protein, 519 aa, Homo sapiens
  ENSP00000386286
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 31035 - protein, 24 aa, Homo sapiens
  ENSP00000408722
MSVVLVLLPTLLLVMLTGAQRACP

SEQ ID NO: 31036 - protein, 345 aa, Homo sapiens
  ENSP00000273286
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 31037 - protein, 269 aa, Homo sapiens
  ENSP00000419772
MTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 31038 - protein, 91 aa, Homo sapiens
  ENSP00000410758
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 31039 - protein, 62 aa, Homo sapiens
  ENSP00000386363
MKSDKEIVGTLLGFDDFVNMVLEDVTEFEITPEGRRITKLDQILLNGNNITMLVPGGEGPEV

SEQ ID NO: 31040 - protein, 62 aa, Homo sapiens; identical to SEQ ID NO: 31039
  ENSP00000386814

SEQ ID NO: 31041 - protein, 62 aa, Homo sapiens; identical to SEQ ID NO: 31039
  ENSP00000386707

SEQ ID NO: 31042 - protein, 64 aa, Homo sapiens
  ENSP00000386275
MAANATTNPSQLLPLELVDKCIGSRIHIVMKSDKEIVGTLLGFDDFVSILLKVKSHQKEEGLLN

SEQ ID NO: 31043 - protein, 71 aa, Homo sapiens
  ENSP00000223084
MAANATTNPSQLLPLGNRRPLGSRNRELTFRIGGRGAVPRQALAECGEMYKTKCGSTLSSKSSRQQAAPAL

SEQ ID NO: 31044 - protein, 62 aa, Homo sapiens; identical to SEQ ID NO: 31039
  ENSP00000387109

SEQ ID NO: 31045 - protein, 62 aa, Homo sapiens; identical to SEQ ID NO: 31039
  ENSP00000387126

SEQ ID NO: 31046 - protein, 1821 aa, Homo sapiens
  ENSP00000261978
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 31047 - protein, 1769 aa, Homo sapiens
  ENSP00000452110
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPGLCCCKTGEEVGTKAVSLPSPPPASHIASRSPQPASKGFRRRSAAS

SEQ ID NO: 31048 - protein, 1777 aa, Homo sapiens
  ENSP00000451477
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 31049 - protein, 233 aa, Homo sapiens
  ENSP00000450668
  MOD_RES (1)..(1): Any amino acid
XTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDIDECEDYGDPVCGTWKCENSPGSYRCVLGCQPGFHMAPNGDCIDIDECANDTMCGSHGFCDNTDGSFRCLCDQGFEISPSGW

SEQ ID NO: 31050 - protein, 803 aa, Homo sapiens
  ENSP00000347293
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 31051 - protein, 864 aa, Homo sapiens
  ENSP00000263800
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 31052 - protein, 562 aa, Homo sapiens
  ENSP00000458111
MGCWGQLLVWFGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 31053 - protein, 734 aa, Homo sapiens
  ENSP00000392196
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGGAWPGPVLASATRCHRGFPSQCYSAQTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 31054 - protein, 239 aa, Homo sapiens
  ENSP00000361048
MEGTVESQTPDLRDVEGKVGRKTPEGLLRGLRGECELGTSGALLLPGASSTGHDLGDKIMALKMELAYLRAIDVKILQQLVTLNEGIEAVRWLLEERGTLTSHCSSLTSSQYSLTGGSPGRSRRGSWDSLPDTSTTDRLDSVSIGSFLDTVAPSELDEQGPPGAPRSEMDWAKVIAGGERARTEVDVAATRLGSLRAVWKPPGERLQGGPPESPEDESAKLGFEAHWFWEQCQDDVTFL

SEQ ID NO: 31055 - protein, 228 aa, Homo sapiens
  ENSP00000321026
MEDSPLPDLRDIELKLGRKVPESLVRSLRGEEPVPRERDRDPCGGSGGGGGGGGGCSSSSSYCSFPPSLSSSSSSSPTSGSPRGSHSSALERLETKLHLLRQEMVNLRATDVRLMRQLLVINESIESIKWMIEEKATITSRGSSLSGSLCSLLESQSTSLRGSYNSLHDGSDGLDGISVGSYLDTLADDVPGHQTPSDLDQFSDSSLIEDSQALHKRPKLDSEYYCFG

SEQ ID NO: 31056 - protein, 147 aa, Homo sapiens
  ENSP00000428427
MTSGIPGCGGACVLPSRAPLRRRDPQHCSPTLSEAPLLRAHTQTRLLTRGLPTPNTTRTVQVSVTVTPTWSPVRPRQDRLLWFVTSRQDGHPLQNEDLLASAAGCPSGCGASQLADVLLLLEPEEQSVLPEADHLLRPGQLLRDCVC

SEQ ID NO: 31057 - protein, 131 aa, Homo sapiens
  ENSP00000292494
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 31058 - protein, 131 aa, Homo sapiens; identical to SEQ ID NO: 31057
  ENSP00000414307

SEQ ID NO: 31059 - protein, 131 aa, Homo sapiens; identical to SEQ ID NO: 31057
  ENSP00000427915

SEQ ID NO: 31060 - protein, 73 aa, Homo sapiens
  ENSP00000430131
MKIFLPVLLAALLGVERASSLMCFSCLNQKSNLYCLKPTICSDQDNYCVTVSASAGIGECQASDRAFLPWPSP

SEQ ID NO: 31061 - protein, 131 aa, Homo sapiens; identical to SEQ ID NO: 31057
  ENSP00000428572

SEQ ID NO: 31062 - protein, 131 aa, Homo sapiens; identical to SEQ ID NO: 31057
  ENSP00000428169

SEQ ID NO: 31063 - protein, 41 aa, Homo sapiens
  ENSP00000428365
MKIFLPVLLAALLGVEREEQSVLPEADHLLRPGQLLRDCVC

SEQ ID NO: 31064 - protein, 131 aa, Homo sapiens; identical to SEQ ID NO: 31057
  ENSP00000428159

SEQ ID NO: 31065 - protein, 66 aa, Homo sapiens
  ENSP00000430796
MKIFLPVLLAALLGVERASSLMCFSCLNQKSNLYCLKPTICSDQDNYCVTVSASAGIASFPMQGIS

SEQ ID NO: 31066 - protein, 41 aa, Homo sapiens; identical to SEQ ID NO: 31063
  ENSP00000430770

SEQ ID NO: 31067 - protein, 66 aa, Homo sapiens; identical to SEQ ID NO: 31065
  ENSP00000428467

SEQ ID NO: 31068 - protein, 66 aa, Homo sapiens
  ENSP00000430700
MKIFLPVLLAALLGVERASSLMCFSCLNQKSNLYCLKPTICSDQDNYCVTVSASAGIGGFAGGTDS

SEQ ID NO: 31069 - protein, 131 aa, Homo sapiens; identical to SEQ ID NO: 31057
  ENSP00000428442

SEQ ID NO: 31070 - protein, 147 aa, Homo sapiens; identical to SEQ ID NO: 31056
  ENSP00000488311

SEQ ID NO: 31071 - protein, 131 aa, Homo sapiens; identical to SEQ ID NO: 31057
  ENSP00000482517

SEQ ID NO: 31072 - protein, 131 aa, Homo sapiens; identical to SEQ ID NO: 31057
  ENSP00000488421

SEQ ID NO: 31073 - protein, 131 aa, Homo sapiens; identical to SEQ ID NO: 31057
  ENSP00000488443

SEQ ID NO: 31074 - protein, 73 aa, Homo sapiens; identical to SEQ ID NO: 31060
  ENSP00000488115

SEQ ID NO: 31075 - protein, 131 aa, Homo sapiens; identical to SEQ ID NO: 31057
  ENSP00000488556

SEQ ID NO: 31076 - protein, 131 aa, Homo sapiens; identical to SEQ ID NO: 31057
  ENSP00000487664

SEQ ID NO: 31077 - protein, 41 aa, Homo sapiens; identical to SEQ ID NO: 31063
  ENSP00000488743

SEQ ID NO: 31078 - protein, 131 aa, Homo sapiens; identical to SEQ ID NO: 31057
  ENSP00000488891

SEQ ID NO: 31079 - protein, 66 aa, Homo sapiens; identical to SEQ ID NO: 31065
  ENSP00000488121

SEQ ID NO: 31080 - protein, 41 aa, Homo sapiens; identical to SEQ ID NO: 31063
  ENSP00000488414

SEQ ID NO: 31081 - protein, 66 aa, Homo sapiens; identical to SEQ ID NO: 31065
  ENSP00000487700

SEQ ID NO: 31082 - protein, 66 aa, Homo sapiens; identical to SEQ ID NO: 31068
  ENSP00000488627

SEQ ID NO: 31083 - protein, 131 aa, Homo sapiens; identical to SEQ ID NO: 31057
  ENSP00000488559

SEQ ID NO: 31084 - protein, 141 aa, Homo sapiens
  ENSP00000380605
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 31085 - protein, 89 aa, Homo sapiens
  ENSP00000340563
MCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 31086 - protein, 39 aa, Homo sapiens
  ENSP00000396651
MWVLGIAATFCGLFLLPGENTQRPAAEARLCAANPVLPV

SEQ ID NO: 31087 - protein, 171 aa, Homo sapiens
  ENSP00000334463
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 31088 - protein, 76 aa, Homo sapiens
  ENSP00000396855
MEPGPALAWLLLLSLLADCLKAAQSRDFTVKDIIYLHPSTTPYPGGFKCFTCEKAADNYECNRWAPDIYCPRGTMI

SEQ ID NO: 31089 - protein, 53 aa, Homo sapiens
  ENSP00000392286
MEPGPALAWLLLLSLLADCLKAAQSRDFTVKDIIYLHPSTTPYPGGFKCFTCE

SEQ ID NO: 31090 - protein, 76 aa, Homo sapiens; identical to SEQ ID NO: 31088
  ENSP00000376594

SEQ ID NO: 31091 - protein, 171 aa, Homo sapiens; identical to SEQ ID NO: 31087
  ENSP00000386413

SEQ ID NO: 31092 - protein, 207 aa, Homo sapiens
  ENSP00000387077
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 31093 - protein, 183 aa, Homo sapiens
  ENSP00000386479
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 31094 - protein, 183 aa, Homo sapiens; identical to SEQ ID NO: 31093
  ENSP00000386650

SEQ ID NO: 31095 - protein, 50 aa, Homo sapiens
  ENSP00000388361
MLCERHCTEEDENHSKPNKGNAEEIFSAEYWKVRFPASRISGNVNEQHEA

SEQ ID NO: 31096 - protein, 74 aa, Homo sapiens
  ENSP00000412070
MLLITLSANLFTVPERSLTTTFSFSRCERHCTEEDENHSKPNKGNAEEIFSAEYWKVRFPASRISGNVNEQHEA

SEQ ID NO: 31097 - protein, 54 aa, Homo sapiens
  ENSP00000410840
MLYKSSDRPAHKVSMLLLCHALAIAVVQIVIFSESWAFAKNINFYNVRPPLDHK

SEQ ID NO: 31098 - protein, 183 aa, Homo sapiens
  ENSP00000280115
MRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 31099 - protein, 122 aa, Homo sapiens
  ENSP00000454826
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 31100 - protein, 33 aa, Homo sapiens
  ENSP00000396868
MGLTPLRGRGLRSQEKLRKLSKPVYLRSHDEVS

SEQ ID NO: 31101 - protein, 107 aa, Homo sapiens
  ENSP00000457743
MTTATRQEVLGLYRSIFRLARKWQATSGQMEDTIKEKQYILNEARTLFRKNKNLTDTDLIKQCIDECTARIEIGLHYKIPYPRPVSVTPVNKCWVLTLINLVISKNV

SEQ ID NO: 31102 - protein, 122 aa, Homo sapiens; identical to SEQ ID NO: 31099
  ENSP00000454551

SEQ ID NO: 31103 - protein, 107 aa, Homo sapiens; identical to SEQ ID NO: 31101
  ENSP00000454890

SEQ ID NO: 31104 - protein, 33 aa, Homo sapiens; identical to SEQ ID NO: 31100
  ENSP00000454759

SEQ ID NO: 31105 - protein, 122 aa, Homo sapiens; identical to SEQ ID NO: 31099
  ENSP00000457333

SEQ ID NO: 31106 - protein, 122 aa, Homo sapiens; identical to SEQ ID NO: 31099
  ENSP00000379367

SEQ ID NO: 31107 - protein, 122 aa, Homo sapiens; identical to SEQ ID NO: 31099
  ENSP00000407883

SEQ ID NO: 31108 - protein, 122 aa, Homo sapiens; identical to SEQ ID NO: 31099
  ENSP00000219168

SEQ ID NO: 31109 - protein, 146 aa, Homo sapiens
  ENSP00000287748
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 31110 - protein, 146 aa, Homo sapiens; identical to SEQ ID NO: 31109
  ENSP00000387897

SEQ ID NO: 31111 - protein, 767 aa, Homo sapiens
  ENSP00000273390
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVSLVENHLAGLEGRALADMFDFLSKELVRLQEERRIHAFVMLAERQRRVREAEESGRRQVEKQRLREEDEIFKEVVKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 31112 - protein, 47 aa, Homo sapiens
  ENSP00000419520
MSHAVTIEEPQAQPQVSQTRYRERSRAGSHISSNRAYDFLYEKSSQV

SEQ ID NO: 31113 - protein, 238 aa, Homo sapiens
  ENSP00000419489
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGELVNLLTIGR

SEQ ID NO: 31114 - protein, 55 aa, Homo sapiens
  ENSP00000418601
MSHAVTIEEPQAQPQVSQTRYRERSRAGSHISSNRAYDFLYGKDRRRPSSASVAS

SEQ ID NO: 31115 - protein, 131 aa, Homo sapiens
  ENSP00000419972
MSHAVTIEEPQAQPQVSQTRYRERSRAGSHISSNRAYDFLYELTLLFRCLKKFMKILKLLERIAINTLKGLFSHFFSRCHSMLFMPYPRQNHTLFLLLLLSTYPSLQSLLWALRLIIGMLTFKQIHTLQNM

SEQ ID NO: 31116 - protein, 101 aa, Homo sapiens
  ENSP00000419554
EWKGHKEKHREALRQLTTCLKKFMKILKLLERIAINTLKGLFSHFFSRCHSMLFMPYPRQNHTLFLLLLLSTYPSLQSLLWALRLIIGMLTFKQIHTLQNM

SEQ ID NO: 31117 - protein, 383 aa, Homo sapiens
  ENSP00000455097
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFMYPRESSTSVM

SEQ ID NO: 31118 - protein, 403 aa, Homo sapiens
  ENSP00000327048
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFITEPTRKLEPSVGYATFWKPQHRVLTSVFTK

SEQ ID NO: 31119 - protein, 373 aa, Homo sapiens
  ENSP00000377019
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFM

SEQ ID NO: 31120 - protein, 164 aa, Homo sapiens
  ENSP00000345393
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 31121 - protein, 93 aa, Homo sapiens
  ENSP00000391589
MGLSVRELNRHLRGLSAEEVTRLKQRRRTLKNRGYAASCRVKRVCQKEELQKQKSELEREVDKLARENAAMRLELDALRGKCEALQGFARSVA

SEQ ID NO: 31122 - protein, 125 aa, Homo sapiens
  ENSP00000416493
MSVDPLSSKALKIKRELSENTPHLSDEALMGLSVRELNRHLRGLSAEEVTRLKQRRRTLKNRGYAASCRVKRVCQKEELQKQKSELEREVDKLARENAAMRLELDALRGKCEALQGFARSVAAAR

SEQ ID NO: 31123 - protein, 164 aa, Homo sapiens; identical to SEQ ID NO: 31120
  ENSP00000384094

SEQ ID NO: 31124 - protein, 135 aa, Homo sapiens
  ENSP00000441482
MGLSVRELNRHLRGLSAEEVTRLKQRRRTLKNRGYAASCRVKRVCQKEELQKQKSELEREVDKLARENAAMRLELDALRGKCEALQGFARSVAAARGPATLVAPASVITIVKSTPGSGSGPAHGPDPAHGPASCS

SEQ ID NO: 31125 - protein, 164 aa, Homo sapiens; identical to SEQ ID NO: 31120
  ENSP00000388882

SEQ ID NO: 31126 - protein, 164 aa, Homo sapiens; identical to SEQ ID NO: 31120
  ENSP00000442060

SEQ ID NO: 31127 - protein, 131 aa, Homo sapiens
  ENSP00000470772
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVE

SEQ ID NO: 31128 - protein, 626 aa, Homo sapiens
  ENSP00000376048
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 31129 - protein, 582 aa, Homo sapiens
  ENSP00000355234
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 31130 - protein, 158 aa, Homo sapiens
  ENSP00000473125
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVS

SEQ ID NO: 31131 - protein, 58 aa, Homo sapiens
  ENSP00000473245
MIFLTALPLFWIMISASRGGHWGAWMPSSISAFEGTCVSIPCRFDFPDELRPAVVHGV

SEQ ID NO: 31132 - protein, 601 aa, Homo sapiens
  ENSP00000440695
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 31133 - protein, 131 aa, Homo sapiens; identical to SEQ ID NO: 31127
  ENSP00000470772

SEQ ID NO: 31134 - protein, 626 aa, Homo sapiens; identical to SEQ ID NO: 31128
  ENSP00000376048

SEQ ID NO: 31135 - protein, 582 aa, Homo sapiens; identical to SEQ ID NO: 31129
  ENSP00000355234

SEQ ID NO: 31136 - protein, 158 aa, Homo sapiens; identical to SEQ ID NO: 31130
  ENSP00000473125

SEQ ID NO: 31137 - protein, 58 aa, Homo sapiens; identical to SEQ ID NO: 31131
  ENSP00000473245

SEQ ID NO: 31138 - protein, 601 aa, Homo sapiens; identical to SEQ ID NO: 31132
  ENSP00000440695

SEQ ID NO: 31139 - protein, 1150 aa, Homo sapiens
  ENSP00000358630
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDFTLVAQAGVQWHDLGSLQPPPPGFNHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 31140 - protein, 1481 aa, Homo sapiens
  ENSP00000304604
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGDWDINNPSSSNVIYDEQSPLPPSSHFASIFEESHVPVIEESLRVQICEKAEELKDIVPEKKSTLNENQPEIKHQSLLQKNVSKRDPPSSHGHSNKKNLLKVENGVTRRGRSVSPKKPASQHSEEHLDKIPSPLKNNPKRRPRDQSLSPSKGENKSCQVSTRAGSGQDQCRKSRGRSASPKKQQKIEGSKAPSNAEAKLLEGKSRRIAGYTGSNAEQIPDGKEKSDVIRKDAKQNQLEKSRTRSPEKKIKRMVEKSLPSKMTNKTTSKEVSENEKGKKVTTGETSSSNDKIGENVQLSEKRLKQEPEEKVVSNKTEDHKGKELEAADKNKETGRFKPESSSPVKKTLITPGPWKVPSGNKVTGTIGMAEKRQ

SEQ ID NO: 31141 - protein, 1125 aa, Homo sapiens
  ENSP00000358628
MSKTLKKKKHWLSKVQECAVSWAGPPGDFGAEIRGGAERGEFPYLGRLREEPGGGTCCVVSGKAPSPGDVLLEVNGTPVSGLTNRDTLAVIRHFREPIRLKTVKPGKVINKDLRHYLSLQFQKGSIDHKLQQVIRDNLYLRTIPCTTRAPRDGEVPGVDYNFISVEQFKALEESGALLESGTYDGNFYGTPKPPAEPSPFQPDPVDQVLFDNEFDAESQRKRTTSVSKMERMDSSLPEEEEDEDKEAINGSGNAENRERHSESSDWMKTVPSYNQTNSSMDFRNYMMRDETLEPLPKNWEMAYTDTGMIYFIDHNTKTTTWLDPRLCKKAKAPEDCEDGELPYGWEKIEDPQYGTYYVDHLNQKTQFENPVEEAKRKKQLGQVEIGSSKPDMEKSHFTRDPSQLKGVLVRASLKKSTMGFGFTIIGGDRPDEFLQVKNVLKDGPAAQDGKIAPGDVIVDINGNCVLGHTHADVVQMFQLVPVNQYVNLTLCRGYPLPDDSEDPVVDIVAATPVINGQSLTKGETCMNPQDFKPGAMVLEQNGKSGHTLTGDGLNGPSDASEQRVSMASSGSSQPELVTIPLIKGPKGFGFAIADSPTGQKVKMILDSQWCQGLQKGDIIKEIYHQNVQNLTHLQVVEVLKQFPVGADVPLLILRGGPPSPTKTAKMKTDKKENAGSLEAINEPIPQPMPFPPSIIRSGSPKLDPSEVYLKSKTLYEDKPPNTKDLDVFLRKQESGFGFRVLGGDGPDQSIYIGAIIPLGAAEKDGRLRAADELMCIDGIPVKGKSHKQVLDLMTTAARNGHVLLTVRRKIFYGEKQPEDDSSQAFISTQNGSPRLNRAEVPARPAPQEPYDVVLQRKENEGFGFVILTSKNKPPPGVIPHKIGRVIEGSPADRCGKLKVGDHISAVNGQSIVELSHDNIVQLIKDAGVTVTLTVIAEEEHHGPPSGTNSARQSPALQHRPMGQSQANHIPGDRSALEGEIGKDVSTSYRHSWSDHKHLAQPDTAVISVVGSRHNQNLGCYPVELERGPRGFGFSLRGGKEYNMGLFILRLAEDGPAIKDGRIHVGDQIVEINGEPTQGITHTRAIELIQAGGNKVLLLLRPGTGLIPDHGLAPSGLCSYVKPEQH

SEQ ID NO: 31142 - protein, 1125 aa, Homo sapiens; identical to SEQ ID NO: 31141
  ENSP00000358624

SEQ ID NO: 31143 - protein, 367 aa, Homo sapiens
  ENSP00000354649
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 31144 - protein, 335 aa, Homo sapiens
  ENSP00000480732
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 31145 - protein, 134 aa, Homo sapiens
  ENSP00000362433
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMFQVF

SEQ ID NO: 31146 - protein, 367 aa, Homo sapiens; identical to SEQ ID NO: 31143
  ENSP00000478379

SEQ ID NO: 31147 - protein, 623 aa, Homo sapiens
  ENSP00000313021
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 31148 - protein, 623 aa, Homo sapiens; identical to SEQ ID NO: 31147
  ENSP00000476067

SEQ ID NO: 31149 - protein, 648 aa, Homo sapiens
  ENSP00000346484
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAEESIIKPIEKLSCNETFPEKLEDPQGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 31150 - protein, 583 aa, Homo sapiens
  ENSP00000442221
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAEYTWNTKTGRGQFSGRTYNPTAKNLNIVNRAQPIPSVHGRTDWVAKYGGHR

SEQ ID NO: 31151 - protein, 457 aa, Homo sapiens
  ENSP00000442250
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRQQVKMAVISLSAHQFPTL

SEQ ID NO: 31152 - protein, 153 aa, Homo sapiens
  ENSP00000310880
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 31153 - protein, 111 aa, Homo sapiens
  ENSP00000306568
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 31154 - protein, 97 aa, Homo sapiens
  ENSP00000304924
MAPAAATGGSTLPSGFSVFTTLPDLLFIFEFDAAYHCTAALFYLSASVLEALATITMQDGFTYRHYHENIAAVVFSYIATLLYVVHAVFSLIRWKSS

SEQ ID NO: 31155 - protein, 55 aa, Homo sapiens
  ENSP00000322860
MAPAAATGGSTLPSGFSVFTTLPDLLFIFEFVFSYIATLLYVVHAVFSLIRWKSS

SEQ ID NO: 31156 - protein, 108 aa, Homo sapiens
  ENSP00000483044
MFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 31157 - protein, 108 aa, Homo sapiens; identical to SEQ ID NO: 31156
  ENSP00000482729

SEQ ID NO: 31158 - protein, 176 aa, Homo sapiens
  ENSP00000479708
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 31159 - protein, 108 aa, Homo sapiens; identical to SEQ ID NO: 31156
  ENSP00000484544

SEQ ID NO: 31160 - protein, 415 aa, Homo sapiens
  ENSP00000324175
MTLAASSQRSQIIRSKFRSVLQLRIHRRNQEQISDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 31161 - protein, 312 aa, Homo sapiens
  ENSP00000349192
MPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 31162 - protein, 247 aa, Homo sapiens
  ENSP00000471590
MPPEPRQGSRADPQAEGSALGPPGPSLWEGTDSQQPHPRMKPSPLTPCPPGVPSPSPPPHKLELQTLKLEELTVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 31163 - protein, 219 aa, Homo sapiens
  ENSP00000469544
MTLAASSQRSQIIRSKFRSVLQLRIHRRNQEQNPVQAPISQQSSLAPWPALRHPGAPLSTQPCSSRPGLLPAGLSGSFTVSPVSDPDPWISASDPPLAPALPSGTAPFLFSPGVLLPEPEYCPPWRSPKKESPKISQRWRESKPRGNLTYHQYMPPEPRQGSRADPQAEGSALGPPGPSLWEGTDSQQPHPRMKPSPLTPCPPGVPSPSPPPHKLELQT

SEQ ID NO: 31164 - protein, 11 aa, Homo sapiens
  ENSP00000469127
MPPEPRQGSRA

SEQ ID NO: 31165 - protein, 653 aa, Homo sapiens
  ENSP00000357453
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 31166 - protein, 630 aa, Homo sapiens
  ENSP00000363452
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 31167 - protein, 450 aa, Homo sapiens
  ENSP00000263979
MMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 31168 - protein, 401 aa, Homo sapiens
  ENSP00000363449
MELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 31169 - protein, 362 aa, Homo sapiens [sequence omitted]

SEQ ID NO: 31170 - protein, 1144 aa, Homo sapiens
  ENSP00000261483
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 31171 - protein, 334 aa, Homo sapiens
  ENSP00000468348
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 31172 - protein, 68 aa, Homo sapiens
  ENSP00000351997
MSQSKGKKRNPGLKIPKEAFEQPQTSSTPPRDLDSKACISIGNQNFEVKADDLEPIMELGRADPSHSK

SEQ ID NO: 31173 - protein, 84 aa, Homo sapiens
  ENSP00000466143
MELGRGAYGVVEKMRHVPSGQIMAVKRIRATVNSQEQKRLLMDLDISMRTVDCPFTVTFYGALFREGDVWICMELMDTSLDKFY

SEQ ID NO: 31174 - protein, 128 aa, Homo sapiens
  ENSP00000464916
MSHRAWAEGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDV

SEQ ID NO: 31175 - protein, 278 aa, Homo sapiens
  ENSP00000467213
MELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 31176 - protein, 278 aa, Homo sapiens; identical to SEQ ID NO: 31175
  ENSP00000477701

SEQ ID NO: 31177 - protein, 199 aa, Homo sapiens
  ENSP00000314560
MAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQVPEVRKKFTPNPSAIFQASAPRILNV

SEQ ID NO: 31178 - protein, 182 aa, Homo sapiens
  ENSP00000388945
MAWPCISRLCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRQEFQAWTGVKPSRSTKTKPARVITTHTSGWDSSPGAGFQASAPRILNV

SEQ ID NO: 31179 - protein, 133 aa, Homo sapiens
  ENSP00000390816
  MOD_RES (1)..(1): Any amino acid
XCCLARRWNQLDRSDVAVPLTLHGYSDLDSEEPGTGGAASRRGQPPAGARDSGRDVPLTQYQRDFGLWTTPAGPKDPPPGRGPGAGGRRGKSSAQSSAPPAPGARGVYVLPIGDADAAAAVTTSYRNSRLGLE

SEQ ID NO: 31180 - protein, 749 aa, Homo sapiens
  ENSP00000346581
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31181 - protein, 771 aa, Homo sapiens
  ENSP00000414712
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31182 - protein, 734 aa, Homo sapiens
  ENSP00000445737
MEDTKLYSPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31183 - protein, 734 aa, Homo sapiens
  ENSP00000400790
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31184 - protein, 603 aa, Homo sapiens
  ENSP00000482998
MERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31185 - protein, 655 aa, Homo sapiens
  ENSP00000483511
MAELGAGGDGHRGGDGAVRSETAPDSYKVQDKKNASSRPASAISGQNNNHSGNKPDPPPVLRVDDRQRLARERREEREKQLDPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31186 - protein, 603 aa, Homo sapiens; identical to SEQ ID NO: 31184
  ENSP00000414879

SEQ ID NO: 31187 - protein, 779 aa, Homo sapiens
  ENSP00000482335
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAVIPICPRSASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31188 - protein, 712 aa, Homo sapiens
  ENSP00000482356
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 31189 - protein, 277 aa, Homo sapiens
  ENSP00000379126
MRHENVIGLLDVFTPDETLDDFTDFYLVMPFMGTDLGKLMKHEKLGEDRIQFLVYQMLKGLRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 31190 - protein, 367 aa, Homo sapiens
  ENSP00000215659
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 31191 - protein, 119 aa, Homo sapiens
  ENSP00000379124
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDLKVPCSGPWHQVCGR

SEQ ID NO: 31192 - protein, 357 aa, Homo sapiens
  ENSP00000479972
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 31193 - protein, 281 aa, Homo sapiens
  ENSP00000465661
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKSTDCITSIVGHIPEPSEKGEVREVPFVLLSVLCKSNWGEFQSCGVGAAVKRLESEGTLGPGGLMEDSVMLDYVVSLPSLPLHPLLWSRDNDSSHPGRAS

SEQ ID NO: 31194 - protein, 376 aa, Homo sapiens
  ENSP00000439231
MWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 31195 - protein, 233 aa, Homo sapiens
  ENSP00000466233
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGTL

SEQ ID NO: 31196 - protein, 587 aa, Homo sapiens
  ENSP00000383234
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 31197 - protein, 194 aa, Homo sapiens
  ENSP00000468216
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSD

SEQ ID NO: 31198 - protein, 134 aa, Homo sapiens
  ENSP00000465939
MTSLHGLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRAS

SEQ ID NO: 31199 - protein, 78 aa, Homo sapiens
  ENSP00000466871
MAVNVYSTSITQETMSRHDIIAWVNDIVSLNYTKVEQLCSGAAYCQFMDMLFPGCISLKKVKFQAKLEHEYIHNFKLL

SEQ ID NO: 31200 - protein, 315 aa, Homo sapiens
  ENSP00000407723
MKQNRDQKCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 31201 - protein, 127 aa, Homo sapiens
  ENSP00000468904
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPV

SEQ ID NO: 31202 - protein, 327 aa, Homo sapiens
  ENSP00000300249
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 31203 - protein, 274 aa, Homo sapiens
  ENSP00000446343
MARTTTTSSRIITGPSFLSGSTQCAGSVPTGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 31204 - protein, 259 aa, Homo sapiens
  ENSP00000468588
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVMHQLWPRL

SEQ ID NO: 31205 - protein, 284 aa, Homo sapiens
  ENSP00000464921
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 31206 - protein, 284 aa, Homo sapiens; identical to SEQ ID NO: 31205
  ENSP00000396074

SEQ ID NO: 31207 - protein, 94 aa, Homo sapiens
  ENSP00000435450
MGASSSSALARLGLPARPWPRWLGVAALGLAAVALGTVAWRRAWPRRRRRLQQVGTVAKLWIYPVKSCKGVPVSEAECTAMGLRSGNLRDRMCA

SEQ ID NO: 31208 - protein, 257 aa, Homo sapiens
  ENSP00000352266
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEASATRRD

SEQ ID NO: 31209 - protein, 335 aa, Homo sapiens
  ENSP00000355880
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 31210 - protein, 172 aa, Homo sapiens
  ENSP00000416442
GHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPR

SEQ ID NO: 31211 - protein, 289 aa, Homo sapiens
  ENSP00000427223
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 31212 - protein, 545 aa, Homo sapiens
  ENSP00000421322
MLGWCEAIARNPHRIPNNTRTPEISGDLADASQTSTLNEKSPGRSASRSSNISKASSPTTGTAPRSQSRLSVCPSTQDICRSAILHDMSEESFEYCTPVMVLSPARKESGKKSVIQRPRRRRKASERYEHAAEEQIRGRKNDFHLQISSPRWRELYTDSSDSSSTDESHWIQAKRRAQVKFRLSRRRRRNNNKPCENLAGSSTPNGIELVDLGSKGKEQQELIECESCSLNLHRGKHTRYQECNPSLTQGSSEIKRSSRNHEKSKGRYHHRDPQLLQSLRKNEIMKKTFSETDSSTEILGVPEGSKDMNDAGLQVNNPVQKPPATYDDGSDNLEVCRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 31213 - protein, 272 aa, Homo sapiens
  ENSP00000345676
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 31214 - protein, 144 aa, Homo sapiens
  ENSP00000424089
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKCLCFCLVHEHCLLNGKAMIT

SEQ ID NO: 31215 - protein, 141 aa, Homo sapiens
  ENSP00000426731
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRK

SEQ ID NO: 31216 - protein, 289 aa, Homo sapiens; identical to SEQ ID NO: 31211
  ENSP00000274056

SEQ ID NO: 31217 - protein, 402 aa, Homo sapiens
  ENSP00000333181
MSFEGGHGGSRCRGAESGDAEPPPQPPPPPPPTPPPGEPAPVPAAPRYLPPLPASPETPERAAGPSEPLGEVAPRCRGADELPPPPLPLQPAGQEVAAAGDSGEGPRRLPEAAAAKGGPGESEAGAGGERERRGAGDQPETRSVCSSRSSSSGGGDQRAGHQHQHHQPICKICFQGAEQGELLNPCRCDGSVRYTHQLCLLKWISERGSWTCELCCYRYHVIAIKMKQPCQWQSISITLVEKVQMIAVILGSLFLIASVTWLLWSAFSPYAVWQRKDILFQICYGMYGFMDLVCIGLIVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 31218 - protein, 54 aa, Homo sapiens
  ENSP00000424425
  MOD_RES (1)..(1): Any amino acid
XLCLLKWISERGSWTCELCCYRYHVIAIKMKQPCQVSLFMKELQFTECLSAGEL

SEQ ID NO: 31219 - protein, 332 aa, Homo sapiens
  ENSP00000478061
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 31220 - protein, 195 aa, Homo sapiens
  ENSP00000362638
MGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 31221 - protein, 558 aa, Homo sapiens
  ENSP00000480068
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31222 - protein, 546 aa, Homo sapiens
  ENSP00000480044
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31223 - protein, 145 aa, Homo sapiens
  ENSP00000480310
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFS

SEQ ID NO: 31224 - protein, 516 aa, Homo sapiens
  ENSP00000480479
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKK

SEQ ID NO: 31225 - protein, 442 aa, Homo sapiens
  ENSP00000477520
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSIALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31226 - protein, 442 aa, Homo sapiens; identical to SEQ ID NO: 31225
  ENSP00000484889

SEQ ID NO: 31227 - protein, 558 aa, Homo sapiens
  ENSP00000323264
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31228 - protein, 546 aa, Homo sapiens
  ENSP00000396244
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31229 - protein, 145 aa, Homo sapiens
  ENSP00000421902
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFS

SEQ ID NO: 31230 - protein, 516 aa, Homo sapiens
  ENSP00000423490
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKK

SEQ ID NO: 31231 - protein, 442 aa, Homo sapiens
  ENSP00000414776
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSIALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 31232 - protein, 442 aa, Homo sapiens; identical to SEQ ID NO: 31231
  ENSP00000398922

SEQ ID NO: 31233 - protein, 699 aa, Homo sapiens
  ENSP00000336792
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 31234 - protein, 728 aa, Homo sapiens
  ENSP00000296280
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 31235 - protein, 615 aa, Homo sapiens
  ENSP00000376264
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 31236 - protein, 380 aa, Homo sapiens
  ENSP00000169293
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 31237 - protein, 354 aa, Homo sapiens
  ENSP00000376262
MFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 31238 - protein, 204 aa, Homo sapiens
  ENSP00000376267
MRPTFMSFRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVI

SEQ ID NO: 31239 - protein, 118 aa, Homo sapiens
  ENSP00000412021
MPANSRDTQGPQNKDKASRTPHRARAHRWLLLYYALCFSLSKASAHTVELNNMFGQIQSPGYPDSYPSDSEVTWNITVPDGFRIKLYFMHFNLESSYLCEYDYVKVETEDQVLATFCG

SEQ ID NO: 31240 - protein, 55 aa, Homo sapiens
  ENSP00000409047
MFGQIQSPGYPDSYPSDSEVTWNITVPDGFRIKLYFMHFNLESSYLCEYDYVKVE

SEQ ID NO: 31241 - protein, 496 aa, Homo sapiens
  ENSP00000362870
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 31242 - protein, 581 aa, Homo sapiens
  ENSP00000361842
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 31243 - protein, 622 aa, Homo sapiens
  ENSP00000361840
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 31244 - protein, 540 aa, Homo sapiens
  ENSP00000353819
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 31245 - protein, 499 aa, Homo sapiens
  ENSP00000243983
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 31246 - protein, 581 aa, Homo sapiens; identical to SEQ ID NO: 31242
  ENSP00000440328

SEQ ID NO: 31247 - protein, 495 aa, Homo sapiens
  ENSP00000324944
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 31248 - protein, 520 aa, Homo sapiens
  ENSP00000302177
MATTSTTGSTLLQPLSNAVQLPIDQVNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 31249 - protein, 158 aa, Homo sapiens
  ENSP00000419573
KDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRIF

SEQ ID NO: 31250 - protein, 46 aa, Homo sapiens
  ENSP00000420114
MATTSTTGSTLLQPLSNAVQLPIDQLLLCVCSGIPHSVPSYSSLYL

SEQ ID NO: 31251 - protein, 176 aa, Homo sapiens
  ENSP00000417409
MATTSTTGSTLLQPLSNAVQLPIDQAARHMIPGCLSPSVCLTYLAESTGEKYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYI

SEQ ID NO: 31252 - protein, 472 aa, Homo sapiens
  ENSP00000482625
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 31253 - protein, 399 aa, Homo sapiens
  ENSP00000477891
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 31254 - protein, 399 aa, Homo sapiens; identical to SEQ ID NO: 31253
  ENSP00000482884

SEQ ID NO: 31255 - protein, 472 aa, Homo sapiens; identical to SEQ ID NO: 31252
  ENSP00000478088

SEQ ID NO: 31256 - protein, 399 aa, Homo sapiens; identical to SEQ ID NO: 31253
  ENSP00000482369

SEQ ID NO: 31257 - protein, 399 aa, Homo sapiens; identical to SEQ ID NO: 31253
  ENSP00000482742

SEQ ID NO: 31258 - protein, 472 aa, Homo sapiens; identical to SEQ ID NO: 31252
  ENSP00000478041

SEQ ID NO: 31259 - protein, 399 aa, Homo sapiens; identical to SEQ ID NO: 31253
  ENSP00000481758

SEQ ID NO: 31260 - protein, 399 aa, Homo sapiens; identical to SEQ ID NO: 31253
  ENSP00000483526

SEQ ID NO: 31261 - protein, 472 aa, Homo sapiens; identical to SEQ ID NO: 31252
  ENSP00000484199

SEQ ID NO: 31262 - protein, 344 aa, Homo sapiens
  ENSP00000481119
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLR

SEQ ID NO: 31263 - protein, 172 aa, Homo sapiens
  ENSP00000484102
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRT

SEQ ID NO: 31264 - protein, 256 aa, Homo sapiens
  ENSP00000477618
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGC

SEQ ID NO: 31265 - protein, 399 aa, Homo sapiens; identical to SEQ ID NO: 31253
  ENSP00000480894

SEQ ID NO: 31266 - protein, 70 aa, Homo sapiens
  ENSP00000404915
MSPEEWTYLVVLLISIPIGFLFKKAGPGLKRWGAAAVGLGLTLFTCGPHTLHSLVTILGTWALIQAQPCW

SEQ ID NO: 31267 - protein, 399 aa, Homo sapiens; identical to SEQ ID NO: 31253
  ENSP00000344377

SEQ ID NO: 31268 - protein, 472 aa, Homo sapiens; identical to SEQ ID NO: 31252
  ENSP00000245615

SEQ ID NO: 31269 - protein, 123 aa, Homo sapiens
  ENSP00000406794
HTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGAPGPCC

SEQ ID NO: 31270 - protein, 344 aa, Homo sapiens; identical to SEQ ID NO: 31262
  ENSP00000375634

SEQ ID NO: 31271 - protein, 181 aa, Homo sapiens
  ENSP00000472209
  MOD_RES (1)..(1): Any amino acid
XKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSRSGGAREASQDPAAPTSKGWLCP

SEQ ID NO: 31272 - protein, 256 aa, Homo sapiens; identical to SEQ ID NO: 31264
  ENSP00000388250

SEQ ID NO: 31273 - protein, 170 aa, Homo sapiens
  ENSP00000410320
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRY

SEQ ID NO: 31274 - protein, 399 aa, Homo sapiens; identical to SEQ ID NO: 31253
  ENSP00000410503

SEQ ID NO: 31275 - protein, 472 aa, Homo sapiens; identical to SEQ ID NO: 31252
  ENSP00000484954

SEQ ID NO: 31276 - protein, 344 aa, Homo sapiens; identical to SEQ ID NO: 31262
  ENSP00000480531

SEQ ID NO: 31277 - protein, 256 aa, Homo sapiens; identical to SEQ ID NO: 31264
  ENSP00000478623

SEQ ID NO: 31278 - protein, 172 aa, Homo sapiens; identical to SEQ ID NO: 31263
  ENSP00000482316

SEQ ID NO: 31279 - protein, 399 aa, Homo sapiens; identical to SEQ ID NO: 31253
  ENSP00000479760

SEQ ID NO: 31280 - protein, 70 aa, Homo sapiens; identical to SEQ ID NO: 31266
  ENSP00000481141

SEQ ID NO: 31281 - protein, 399 aa, Homo sapiens; identical to SEQ ID NO: 31253
  ENSP00000483987

SEQ ID NO: 31282 - protein, 472 aa, Homo sapiens; identical to SEQ ID NO: 31252
  ENSP00000484933

SEQ ID NO: 31283 - protein, 123 aa, Homo sapiens; identical to SEQ ID NO: 31269
  ENSP00000483561

SEQ ID NO: 31284 - protein, 344 aa, Homo sapiens; identical to SEQ ID NO: 31262
  ENSP00000479750

SEQ ID NO: 31285 - protein, 181 aa, Homo sapiens; identical to SEQ ID NO: 31271
  ENSP00000482357
  MOD_RES (1)..(1): Any amino acid

SEQ ID NO: 31286 - protein, 256 aa, Homo sapiens; identical to SEQ ID NO: 31264
  ENSP00000480282

SEQ ID NO: 31287 - protein, 170 aa, Homo sapiens; identical to SEQ ID NO: 31273
  ENSP00000479717

SEQ ID NO: 31288 - protein, 472 aa, Homo sapiens; identical to SEQ ID NO: 31252
  ENSP00000478965

SEQ ID NO: 31289 - protein, 399 aa, Homo sapiens; identical to SEQ ID NO: 31253
  ENSP00000481864

SEQ ID NO: 31290 - protein, 399 aa, Homo sapiens; identical to SEQ ID NO: 31253
  ENSP00000480575

SEQ ID NO: 31291 - protein, 472 aa, Homo sapiens; identical to SEQ ID NO: 31252
  ENSP00000482252

SEQ ID NO: 31292 - protein, 399 aa, Homo sapiens; identical to SEQ ID NO: 31253
  ENSP00000481544

SEQ ID NO: 31293 - protein, 399 aa, Homo sapiens; identical to SEQ ID NO: 31253
  ENSP00000481947

SEQ ID NO: 31294 - protein, 472 aa, Homo sapiens; identical to SEQ ID NO: 31252
  ENSP00000481455

SEQ ID NO: 31295 - protein, 399 aa, Homo sapiens; identical to SEQ ID NO: 31253
  ENSP00000483839

SEQ ID NO: 31296 - protein, 399 aa, Homo sapiens; identical to SEQ ID NO: 31253
  ENSP00000478522

SEQ ID NO: 31297 - protein, 197 aa, Homo sapiens
  ENSP00000372025
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 31298 - protein, 180 aa, Homo sapiens
  ENSP00000462734
  MOD_RES (1)..(1): Any amino acid
XLPQKSHGRTQDENPVVHFFKNIVTPRTPPPSQGKGRGLSLSRFSWVGDERTSIGFLFRPSPHSPATFVFCSVSVASWPPFLSSRDLSAHSWDRAALSSTGEMKRGLPFRKVWSLASVPGTQPCKARSSSPRGFPGDVTGLPPREGATPRPRKCLTSSNTTSARSPRNPHVEVGLAGPSQ

SEQ ID NO: 31299 - protein, 181 aa, Homo sapiens
  ENSP00000380973
MASQKRPSQRHGSKYLATASTMDHARHGFLPRHRDTGILDSIGRFFGGDRGAPKRGSGKDSHHPARTAHYGSLPQKSHGRTQDENPVVHFFKNICSPRFSVSFQVTPRTPPPSQGKGRGLSLSRFSWGAEGQRPGFGYGGRASDYKSAHKGFKGVDAQGTLSKIFKLGGRDSRSGSPMARR

SEQ ID NO: 31300 - protein, 171 aa, Homo sapiens
  ENSP00000380964
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 31301 - protein, 160 aa, Homo sapiens
  ENSP00000380963
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 31302 - protein, 108 aa, Homo sapiens
  ENSP00000435243
MASQKRPSQRHGSKYLATASTMDHARHGFLPRHRDTGILDSIGRFFGGDRGAPKRGSGKDSHHPARTAHYGSLPQKHTAAETERTWAAERTVDIQASFVFFSCPSLTS

SEQ ID NO: 31303 - protein, 186 aa, Homo sapiens
  ENSP00000352667
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 31304 - protein, 68 aa, Homo sapiens
  ENSP00000436830
MASQKRPSQRHGSKYLATASTMDHARHGFLPRARFPKFLSWEEEIVALDHPWLDAENPPGSGILSSAS

SEQ ID NO: 31305 - protein, 60 aa, Homo sapiens
  ENSP00000462780
  MOD_RES (1)..(1): Any amino acid
XQKRPSQRHGSKYLATASTMDHARHGFLPRHRDTGILDSIGRFFGGDRGAPKRGSGKDCP

SEQ ID NO: 31306 - protein, 32 aa, Homo sapiens
  ENSP00000431267
MASQKRPSQRHGSKYLATASTMDHARHGFLPR

SEQ ID NO: 31307 - protein, 236 aa, Homo sapiens
  ENSP00000380967
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWVGDERTSIGFLFRPSPHSPATFVFCSVSVASWPPFLSSRDLSAHSWDRAALSSTGEMKRGLPFRKGAEGQRPGFGYGGRASDYKSAHKGFKGVDAQGTLSKIFKLGGRDSRSGSPMARR

SEQ ID NO: 31308 - protein, 73 aa, Homo sapiens
  ENSP00000346545
MASQKRPSQRHGSKYLATASTMDHARHGFLPRHRDTGILDSIGRFFGGDRGAPKRGSGKGGRDSRSGSPMARR

SEQ ID NO: 31309 - protein, 59 aa, Homo sapiens
  ENSP00000431335
MASQKRPSQRHGSKYLATASTMDHARHGFLPRTHTTRQELLTTAPCPRSHTAGPKMKTP

SEQ ID NO: 31310 - protein, 59 aa, Homo sapiens; identical to SEQ ID NO: 31309
  ENSP00000462758

SEQ ID NO: 31311 - protein, 64 aa, Homo sapiens
  ENSP00000434011
MASQKRPSQRHGSKYLATASTMDHARHGFLPSGALARTHTTRQELLTTAPCPRSHTAGPKMKTP

SEQ ID NO: 31312 - protein, 149 aa, Homo sapiens
  ENSP00000435641
MASQKRPSQRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 31313 - protein, 304 aa, Homo sapiens
  ENSP00000462223
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 31314 - protein, 253 aa, Homo sapiens
  ENSP00000463780
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGGRDSRSGSPMARR

SEQ ID NO: 31315 - protein, 157 aa, Homo sapiens
  ENSP00000463403
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKL

SEQ ID NO: 31316 - protein, 101 aa, Homo sapiens
  ENSP00000405882
MYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKL

SEQ ID NO: 31317 - protein, 98 aa, Homo sapiens
  ENSP00000432988
MASQKRPSQRHGSKYLATASTMDHARHGFLPRHRDTGILDSIGRFFGGDRGAPKRGSGKDSHHPARTAHYGSLPQKSHGRTQDENPVVHFFKNIAGAR

SEQ ID NO: 31318 - protein, 66 aa, Homo sapiens
  ENSP00000442393
MASQKRPSQRHGSKYLATASTMDHARHGFLPRHRDTGILDSIGRFFGGDRGAPKRGSGKESRTLSR

SEQ ID NO: 31319 - protein, 108 aa, Homo sapiens
  ENSP00000436951
MASQKRPSQRHGSKYLATASTMDHARHGFLPRHRDTGILDSIGRFFGGDRGAPKRGSGKDSHHPARTAHYGSLPQKSHGRTQDENPVVHFFKNIDRSGEAGHPGASGS

SEQ ID NO: 31320 - protein, 171 aa, Homo sapiens
  ENSP00000463137
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWVGDERTSIGFLFRPSPHSPATFVFCSVS

SEQ ID NO: 31321 - protein, 119 aa, Homo sapiens
  ENSP00000435322
MASQKRPSQRHGSKYLATASTMDHARHGFLPRHRDTGILDSIGRFFGGDRGAPKRGSGKDSHHPARTAHYGSLPQKSHGRTQDENPVVHFFKNIVYTSSPTRTEVGRLGTRVLLAADGC

SEQ ID NO: 31322 - protein, 86 aa, Homo sapiens
  ENSP00000437063
MASQKRPSQRHGSKYLATASTMDHARHGFLPRHRDTGILDSIGRFFGGDRGAPKRGSGKDSHHPARTAHYGSLPQKSHGRTQDENP

SEQ ID NO: 31323 - protein, 197 aa, Homo sapiens
  ENSP00000380961
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKVSSEE

SEQ ID NO: 31324 - protein, 197 aa, Homo sapiens; identical to SEQ ID NO: 31323
  ENSP00000380958

SEQ ID NO: 31325 - protein, 159 aa, Homo sapiens
  ENSP00000462374
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHAR

SEQ ID NO: 31326 - protein, 41 aa, Homo sapiens
  ENSP00000463164
MGNHAGKRELNAEKASTNSETNRGESEKKRNLGELSRTTSE

SEQ ID NO: 31327 - protein, 304 aa, Homo sapiens; identical to SEQ ID NO: 31313
  ENSP00000348273

SEQ ID NO: 31328 - protein, 646 aa, Homo sapiens
  ENSP00000264036
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 31329 - protein, 829 aa, Homo sapiens
  ENSP00000305617
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 31330 - protein, 766 aa, Homo sapiens
  ENSP00000421615
MREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 31331 - protein, 1019 aa, Homo sapiens
  ENSP00000386227
MMAAAAAAAAGSSSSGGGGGGSGSSSSSSDTSSTGEEERMRRLFQTCDGDGDGYISRNDLLMVCRQLNMEESVAEIMNQLGADENGKISFQDFTRCRMQLVREIRKEEVDLSAKSDNSCTKKLRDRIASWPTSSDNSLGALSAARESWEYDSGARDLQSPDVQSQSALQKLLEYGGSSLHQQAALHKLLTQSPHIGNSVGGSYLELANTLHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 31332 - protein, 169 aa, Homo sapiens
  ENSP00000485492
  MOD_RES (1)..(1): Any amino acid
XVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKVI

SEQ ID NO: 31333 - protein, 715 aa, Homo sapiens
  ENSP00000485220
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKVGPEWLGDTLRLSDCPVTAQ

SEQ ID NO: 31334 - protein, 350 aa, Homo sapiens
  ENSP00000358022
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 31335 - protein, 271 aa, Homo sapiens
  ENSP00000309973
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 31336 - protein, 197 aa, Homo sapiens
  ENSP00000477624
MFGLKRNAVIGLNLYCGGAGLGAGSGGATRPGGRLLATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 31337 - protein, 999 aa, Homo sapiens
  ENSP00000424126
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 31338 - protein, 692 aa, Homo sapiens
  ENSP00000391639
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 31339 - protein, 515 aa, Homo sapiens
  ENSP00000426417
MDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 31340 - protein, 778 aa, Homo sapiens
  ENSP00000308957
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 31341 - protein, 683 aa, Homo sapiens
  ENSP00000423410
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNEL

SEQ ID NO: 31342 - protein, 489 aa, Homo sapiens
  ENSP00000431075
MGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPL

SEQ ID NO: 31343 - protein, 600 aa, Homo sapiens
  ENSP00000426438
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVALYGTFINV

SEQ ID NO: 31344 - protein, 414 aa, Homo sapiens
  ENSP00000426294
TLKDPHYPDHDLGIILLSVILTPKEGESRDVELSENEVVGSYFSVKSLFWRFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVV

SEQ ID NO: 31345 - protein, 292 aa, Homo sapiens
  ENSP00000425515
  MOD_RES (1)..(1): Any amino acid
XLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEER

SEQ ID NO: 31346 - protein, 191 aa, Homo sapiens
  ENSP00000424936
QKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVFQTQSLRLSDLHRKSHLWRGIVSITLIEGRDLKAMDSNG

SEQ ID NO: 31347 - protein, 169 aa, Homo sapiens
  ENSP00000421543
KIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKVILSL

SEQ ID NO: 31348 - protein, 135 aa, Homo sapiens
  ENSP00000422219
MLDSCKLKSACNLPFICNKTLYGKIGKDRLNAVNKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMG

SEQ ID NO: 31349 - protein, 81 aa, Homo sapiens
  ENSP00000422317
MLDSCKLKSACNLPFICNKKIINTAGTSNAEVPLADPGMYQLDITLRRGQSLAARDRGGTSDPYVKFKIGGKEVFRSKIIH

SEQ ID NO: 31350 - protein, 213 aa, Homo sapiens
  ENSP00000413226
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCD

SEQ ID NO: 31351 - protein, 231 aa, Homo sapiens
  ENSP00000393881
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESAD

SEQ ID NO: 31352 - protein, 246 aa, Homo sapiens
  ENSP00000362142
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 31353 - protein, 98 aa, Homo sapiens
  ENSP00000406600
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTP

SEQ ID NO: 31354 - protein, 246 aa, Homo sapiens; identical to SEQ ID NO: 31352
  ENSP00000230321

SEQ ID NO: 31355 - protein, 185 aa, Homo sapiens
  ENSP00000362141
MYQVSGQRPSGCDAPYGAPSAAPGPGQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 31356 - protein, 128 aa, Homo sapiens
  ENSP00000411829
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHR

SEQ ID NO: 31357 - protein, 142 aa, Homo sapiens
  ENSP00000403587
MYQVSGQRPSGCDAPYGAPSAAPGPGQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCC

SEQ ID NO: 31358 - protein, 955 aa, Homo sapiens
  ENSP00000402584
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 31359 - protein, 973 aa, Homo sapiens
  ENSP00000422042
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 31360 - protein, 159 aa, Homo sapiens
  ENSP00000393330
  MOD_RES (1)..(1): Any amino acid
XNQHNAVVKAIPVRRVEKGQLLEYILTDLRVPHSYEVRLTPYTTFGAGDMASRIIHYTEHNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLN

SEQ ID NO: 31361 - protein, 87 aa, Homo sapiens
  ENSP00000425911
  MOD_RES (1)..(1): Any amino acid
XHKLSKNYSYVLQWTQREPDAVDPVLNYRLSIRQLNQHNAVVKAIPVRRVEKGQLLEYILTDLRVPHSYETTPATLRMRRSVAIPRT

SEQ ID NO: 31362 - protein, 129 aa, Homo sapiens
  ENSP00000421510
MLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVD

SEQ ID NO: 31363 - protein, 77 aa, Homo sapiens
  ENSP00000427645
MLQCLVTGHPRPQVRWTKTAGSASDKFQETSVFNETLRIERIARTQGGRYYCKAENGVGVPAIKSIRVDVQYLDEPM

SEQ ID NO: 31364 - protein, 1025 aa, Homo sapiens
  ENSP00000382178
MSVWSAGLLRSARRRRRGRTDGRRFLLRRAVPGHLGLARARVERAWLAAGLLKVPLRTPWAGYVHVHVKMDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 31365 - protein, 727 aa, Homo sapiens
  ENSP00000349925
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 31366 - protein, 233 aa, Homo sapiens
  ENSP00000452593
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTGKITIGHQRRRHNRTAMSSNWQT

SEQ ID NO: 31367 - protein, 253 aa, Homo sapiens
  ENSP00000450827
  MOD_RES (1)..(1): Any amino acid
XKILKLKNLRPQDYANYSCIASVRNVCNIPDKMVSFRLSNKTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWS

SEQ ID NO: 31368 - protein, 250 aa, Homo sapiens
  ENSP00000434991
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTGNTIGDKRNILTSSKTLPLESTHLTTDRCGFSIEWKLYKV

SEQ ID NO: 31369 - protein, 142 aa, Homo sapiens
  ENSP00000452515
MFKYESLGICRRTHGSAACFSHSVADSPEVAFCQAKLPFLPPTTVTSEAPPTVRIVHSGLACNIEEERYSERVYTIREGETLELTCLVTGHPRPQIRWTKTAGSASDRFQDSSVFNETLRITNIQRHQGGRYYCKAENGLGS

SEQ ID NO: 31370 - protein, 956 aa, Homo sapiens
  ENSP00000405456
MDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 31371 - protein, 721 aa, Homo sapiens
  ENSP00000403308
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLVSHCFS

SEQ ID NO: 31372 - protein, 756 aa, Homo sapiens
  ENSP00000310760
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEEQSIMAHMGIDSGTTNIFDEVDKSDFKTDFGSEFPIFSPMPGESCENANTSLGRRMSVNCEKLVKREKPRELIFPSNYDLLRHLQYATHFPIPLVSHCFS

SEQ ID NO: 31373 - protein, 2145 aa, Homo sapiens
  ENSP00000417235
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQGQPGDQAALFAAQARPSPQLPQYPGLQQAQTMPQGYTMYGTQMPLQQTSQQQAGSVVLSPSYNSRAYPAAHSNPVLMERLRQIQQQPSGYVQQQASPYLQPLTGSQRLNHQALQQSPLVGGGIDAVLTSAHPNLPSVPLPQDPMRPRQPQVRQQQRLLQMQQPQQPQPQQPPQPQQSSQSQSQTLGLQAMQPQQPLFPRQGLQQTQQQQQTAALVRQLQKQLSSNQPQQGVTPYGHPSHF

SEQ ID NO: 31374 - protein, 1809 aa, Homo sapiens
  ENSP00000273432
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQFPRQGLQQTQQQQQTAALVRQLQKQLSSNQPQQGVTPYGHPSHF

SEQ ID NO: 31375 - protein, 74 aa, Homo sapiens
  ENSP00000417420
  MOD_RES (1)..(1): Any amino acid
XDVKMEIFSPMPGESCENANTSLGRRMSVNCEKLVKREKPRELIFPSNYDLLRHLQYATHFPIPLVLMSVPPSV

SEQ ID NO: 31376 - protein, 473 aa, Homo sapiens
  ENSP00000421925
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31377 - protein, 483 aa, Homo sapiens
  ENSP00000340874
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31378 - protein, 463 aa, Homo sapiens
  ENSP00000389610
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31379 - protein, 462 aa, Homo sapiens
  ENSP00000490354
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31380 - protein, 441 aa, Homo sapiens
  ENSP00000490630
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 31381 - protein, 463 aa, Homo sapiens; identical to SEQ ID NO: 31378
  ENSP00000487430

SEQ ID NO: 31382 - protein, 473 aa, Homo sapiens; identical to SEQ ID NO: 31376
  ENSP00000396219

SEQ ID NO: 31383 - protein, 471 aa, Homo sapiens
  ENSP00000487538
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31384 - protein, 441 aa, Homo sapiens; identical to SEQ ID NO: 31380
  ENSP00000426665

SEQ ID NO: 31385 - protein, 433 aa, Homo sapiens
  ENSP00000422390
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 31386 - protein, 399 aa, Homo sapiens
  ENSP00000425636
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGQNLFLLLETVPPPLRDTHNTRATRRGDLLLTA

SEQ ID NO: 31387 - protein, 441 aa, Homo sapiens; identical to SEQ ID NO: 31380
  ENSP00000490241

SEQ ID NO: 31388 - protein, 441 aa, Homo sapiens; identical to SEQ ID NO: 31380
  ENSP00000424606

SEQ ID NO: 31389 - protein, 465 aa, Homo sapiens
  ENSP00000486554
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31390 - protein, 473 aa, Homo sapiens; identical to SEQ ID NO: 31376
  ENSP00000490473

SEQ ID NO: 31391 - protein, 431 aa, Homo sapiens
  ENSP00000486490
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 31392 - protein, 465 aa, Homo sapiens; identical to SEQ ID NO: 31389
  ENSP00000423597

SEQ ID NO: 31393 - protein, 151 aa, Homo sapiens
  ENSP00000487157
AKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGPYHHPFEIPTTHAPRGGEISC

SEQ ID NO: 31394 - protein, 183 aa, Homo sapiens
  ENSP00000486932
GLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGPYHHPFEIPTTHAPRGGEISC

SEQ ID NO: 31395 - protein, 327 aa, Homo sapiens
  ENSP00000487437
MISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31396 - protein, 393 aa, Homo sapiens
  ENSP00000487184
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 31397 - protein, 417 aa, Homo sapiens
  ENSP00000487311
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 31398 - protein, 242 aa, Homo sapiens
  ENSP00000423826
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPM

SEQ ID NO: 31399 - protein, 227 aa, Homo sapiens
  ENSP00000423656
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSP

SEQ ID NO: 31400 - protein, 205 aa, Homo sapiens
  ENSP00000485972
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSG

SEQ ID NO: 31401 - protein, 194 aa, Homo sapiens
  ENSP00000427286
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAG

SEQ ID NO: 31402 - protein, 120 aa, Homo sapiens
  ENSP00000424331
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINE

SEQ ID NO: 31403 - protein, 129 aa, Homo sapiens
  ENSP00000427163
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMIS

SEQ ID NO: 31404 - protein, 126 aa, Homo sapiens
  ENSP00000426442
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDL

SEQ ID NO: 31405 - protein, 123 aa, Homo sapiens
  ENSP00000489865
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINED

SEQ ID NO: 31406 - protein, 87 aa, Homo sapiens
  ENSP00000426465
MGRKKIQITRIMDERNRQVTFTKRKFGLMKKAYELSVLCDCEIALIIFNSTNKLFQYASTDMDKVLLKYTEYNEPHESRTNSDIVET

SEQ ID NO: 31407 - protein, 42 aa, Homo sapiens
  ENSP00000490525
  MOD_RES (1)..(1): Any amino acid
XRKKIQITRIMDERNRQLSYFERIGEVTFTKRKFGLMKKAYE

SEQ ID NO: 31408 - protein, 28 aa, Homo sapiens
  ENSP00000427309
MGRKKIQITRIMDERNRQVTFTKRKFGL

SEQ ID NO: 31409 - protein, 1140 aa, Homo sapiens
  ENSP00000423354
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 31410 - protein, 567 aa, Homo sapiens
  ENSP00000423195
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGLF

SEQ ID NO: 31411 - protein, 567 aa, Homo sapiens; identical to SEQ ID NO: 31410
  ENSP00000416284

SEQ ID NO: 31412 - protein, 1140 aa, Homo sapiens; identical to SEQ ID NO: 31409
  ENSP00000274473

SEQ ID NO: 31413 - protein, 1044 aa, Homo sapiens
  ENSP00000386908
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 31414 - protein, 969 aa, Homo sapiens
  ENSP00000288745
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 31415 - protein, 1140 aa, Homo sapiens
  ENSP00000378976
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSDLSQSSSHAHCFSNSSYHALACGGPATSQASTLDRNSPTKLSNKSLDRDTAGWTPYSYVNVLDSHFQISALEARYPPEDFYIELRHLSRPAEPHSPGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 31416 - protein, 579 aa, Homo sapiens
  ENSP00000456118
MGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRKPHLLASQPLRIPCCGLLATVGIVQTSREGGMQAAPGLVVPDSCPTRTEELCRGSSRPDWIQGIDKPKVLEGQGCKAAQQHFLGRTVGAYASVRMAPAVTTSVASAPAAQASPGNTVSRDVPQEPLAMGVSSYVSA

SEQ ID NO: 31417 - protein, 117 aa, Homo sapiens
  ENSP00000478311
  MOD_RES (1)..(1): Any amino acid
XLSQSSSHAHCFSNSSYHALACGGPATSQASTLDRNSPTKLSNKSLDRDTAGWTPYSYVNVLDSHFQISALEARYPPEDFYIELRHLSRPAEPHSPDKPWIQERTDRTRAERCLWNG

SEQ ID NO: 31418 - protein, 26 aa, Homo sapiens
  ENSP00000483007
  MOD_RES (1)..(1): Any amino acid
XWTPYSYVNVLDQCPGGQVPARGLLH

SEQ ID NO: 31419 - protein, 30 aa, Homo sapiens
  ENSP00000477691
  MOD_RES (1)..(1): Any amino acid
XCLPGFSGALCNQASKWQKQILIPTCMLKG

SEQ ID NO: 31420 - protein, 227 aa, Homo sapiens
  ENSP00000401400
MGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPC

SEQ ID NO: 31421 - protein, 1044 aa, Homo sapiens; identical to SEQ ID NO: 31413
  ENSP00000414475

SEQ ID NO: 31422 - protein, 621 aa, Homo sapiens
  ENSP00000480105
GAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRKPHLLASQPLRIPCCGLLATVGIVQTSREGGMQAAPGLVVPDSCPTRTEELCRGSSRPDWIQGIDKPKVLEGQGCKAAQQHFLGRTVGAYASVRMAPAVTTSVASAPAAQASPGNTVSRDVPQEPLAMGVSSYVSA

SEQ ID NO: 31423 - protein, 828 aa, Homo sapiens
  ENSP00000478094
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLS

SEQ ID NO: 31424 - protein, 903 aa, Homo sapiens
  ENSP00000480614
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLS

SEQ ID NO: 31425 - protein, 30 aa, Homo sapiens; identical to SEQ ID NO: 31419
  ENSP00000488336
  MOD_RES (1)..(1): Any amino acid

SEQ ID NO: 31426 - protein, 385 aa, Homo sapiens
  ENSP00000473370
MDVQKWYLRTSKLALALAIIRSKPADKSSREYTEHLAMLLSEEQSKWRSKVEILEAEVMQLRQKLLVSRLCSGSFKSGYVSSQLEAQEPKSSESTLTSMEDSGCDLSNEQRTESSDLSQHFVESCTPTHFPPLPLVKRPCAILQNPLSSHMQFLQYLLELKNLTESGNLKRDLTHFEKDSSTVSDSVFQLLDGLITFYRNPKLPFSRFWTEAVGTLASLISDYNLSSHILKKCSKKLEEFEKTLLHAILGNNHINQFQVQHYVSQSLVTLGNCSLLRKSIISLLLSEVNGFADDLGAINQEQASYDVSRYENIFYLFWVLEQLLQKETEEGNTSSIGHDDQEIKKFLQKHDETIFQLSDAFPLFTFYLWRVGILLSSAQIETLRK

SEQ ID NO: 31427 - protein, 370 aa, Homo sapiens
  ENSP00000454209
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAGKSPIVTVFKSRKRKPSSSHSPGGPLPGK

SEQ ID NO: 31428 - protein, 390 aa, Homo sapiens
  ENSP00000272369
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 31429 - protein, 378 aa, Homo sapiens
  ENSP00000475161
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGKTLFLW

SEQ ID NO: 31430 - protein, 463 aa, Homo sapiens
  ENSP00000381518
MQYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGLQSMPGEYVARGGPMGVSMGQPSYTQPQMPPHPAQLRHGPPMHTYIPGHPHHPTVMMHGGPPHPGMPMSASSPTVLNTGDPTMSGQVMDIHAQ

SEQ ID NO: 31431 - protein, 325 aa, Homo sapiens
  ENSP00000440571
MAQGLRLQGSRRKGRHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 31432 - protein, 121 aa, Homo sapiens
  ENSP00000397418
  MOD_RES (1)..(1): Any amino acid
XLCFESPEISRPVFPCLQMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQ

SEQ ID NO: 31433 - protein, 477 aa, Homo sapiens
  ENSP00000453793
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 31434 - protein, 470 aa, Homo sapiens
  ENSP00000341400
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 31435 - protein, 306 aa, Homo sapiens
  ENSP00000380749
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 31436 - protein, 302 aa, Homo sapiens
  ENSP00000326296
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTVY

SEQ ID NO: 31437 - protein, 388 aa, Homo sapiens
  ENSP00000453390
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 31438 - protein, 98 aa, Homo sapiens
  ENSP00000453481
MAQRYDELPHYGGMDGVGVPASMYGDPHAPRPIPPVHHLNHGPPLHATQHYGAHAPHPNVMPASMGSAVNDALKRDKDAIYGFAPKSHFFPQIQSWTI

SEQ ID NO: 31439 - protein, 381 aa, Homo sapiens
  ENSP00000452693
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 31440 - protein, 306 aa, Homo sapiens; identical to SEQ ID NO: 31435
  ENSP00000380745

SEQ ID NO: 31441 - protein, 401 aa, Homo sapiens
  ENSP00000404185
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 31442 - protein, 394 aa, Homo sapiens
  ENSP00000453497
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 31443 - protein, 235 aa, Homo sapiens
  ENSP00000475899
EGFRWMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAG

SEQ ID NO: 31444 - protein, 139 aa, Homo sapiens
  ENSP00000475660
IQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQEFFRFIPIFQMKWLGLGEGQLLDCHDRKRKQKNEDKAI

SEQ ID NO: 31445 - protein, 105 aa, Homo sapiens
  ENSP00000452874
MIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQ

SEQ ID NO: 31446 - protein, 157 aa, Homo sapiens
  ENSP00000453782
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSG

SEQ ID NO: 31447 - protein, 94 aa, Homo sapiens
  ENSP00000452770
MIQAIQVLRFHLLELEKVHELCDNFCHRYISCLKGKMPIDLVIDERDGSSKSDHEELSGSSTNLADHNPSSWRDHDDATSTHSAGTPGPSSGGH

SEQ ID NO: 31448 - protein, 381 aa, Homo sapiens; identical to SEQ ID NO: 31439
  ENSP00000339549

SEQ ID NO: 31449 - protein, 358 aa, Homo sapiens
  ENSP00000388667
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31450 - protein, 404 aa, Homo sapiens
  ENSP00000333552
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31451 - protein, 250 aa, Homo sapiens
  ENSP00000453757
PPPSLSTPALPPWVAPPSTPVPPQVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31452 - protein, 463 aa, Homo sapiens
  ENSP00000453934
MCTLCTTMRGSYRRCPWISLSVCLSLCLCHCLLTPLSPSLFPPSQTLPSLPLGPPAHMSGISAWTGSSLPTEAAPGDLEGFKLGGSDTWGPQYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31453 - protein, 421 aa, Homo sapiens
  ENSP00000453307
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31454 - protein, 375 aa, Homo sapiens
  ENSP00000454073
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 31455 - protein, 421 aa, Homo sapiens; identical to SEQ ID NO: 31453
  ENSP00000452854

SEQ ID NO: 31456 - protein, 126 aa, Homo sapiens
  ENSP00000475941
FPKVATNIMRAWLFQHLSAGAGRHVIAPSLRLPWSPSWGAQRRSEAPVLPDVCLGLGSPSPGPRWARPWGSDCGRPGRQSDSCWWLQHPYPSEEQKKQLAQDTGLTILQVNNWFINARRRIVQPMI

SEQ ID NO: 31457 - protein, 177 aa, Homo sapiens
  ENSP00000453249
  MOD_RES (1)..(1): Any amino acid
XGLSLPSQVRSERPLFSSNPELDNLGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDC

SEQ ID NO: 31458 - protein, 220 aa, Homo sapiens
  ENSP00000476248
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVSASHLPTPSLAPVIPPPLVASAPHLPALSPPELKQNAAPVPEHPRPAPVGGPPQYPGAPPGPRPVRQLLS

SEQ ID NO: 31459 - protein, 999 aa, Homo sapiens
  ENSP00000295408
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 31460 - protein, 823 aa, Homo sapiens
  ENSP00000387277
MKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 31461 - protein, 96 aa, Homo sapiens
  ENSP00000402129
MGPAPLPLLLGLFLPALWRRAITEAREEAKPYPLFPGPFPGSLQTDHTPLLSLPHASGYQPALMFSPTQPGRPHTGNVAIPQHNQCAAFRQWVVYL

SEQ ID NO: 31462 - protein, 257 aa, Homo sapiens
  ENSP00000412660
HIPLQTLLKFMVDIALGMEYLSNRNFLHRDLAARNCITHLAILARSPASCSYCRLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNG

SEQ ID NO: 31463 - protein, 999 aa, Homo sapiens; identical to SEQ ID NO: 31459
  ENSP00000389152

SEQ ID NO: 31464 - protein, 588 aa, Homo sapiens [sequence omitted]

SEQ ID NO: 31465 - protein, 293 aa, Homo sapiens
  ENSP00000455068
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 31466 - protein, 69 aa, Homo sapiens
  ENSP00000456647
MGFPAAALLCALCCGLLAPAARAGYSEERCSWRGRPRRTRTSAAAWPPSALSCARTGAPSCPRRPTVSA

SEQ ID NO: 31467 - protein, 187 aa, Homo sapiens
  ENSP00000219542
LAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFGECPRHGGSLEPAFP

SEQ ID NO: 31468 - protein, 175 aa, Homo sapiens
  ENSP00000459900
  MOD_RES (1)..(1): Any amino acid
XAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVGGPTALEVMGLSIRTLFT

SEQ ID NO: 31469 - protein, 160 aa, Homo sapiens
  ENSP00000457702
MLGCICQMGVQEGGPGQLIARHGPQAHVCVHSCLGGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 31470 - protein, 244 aa, Homo sapiens
  ENSP00000448785
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 31471 - protein, 180 aa, Homo sapiens
  ENSP00000450239
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAEC

SEQ ID NO: 31472 - protein, 244 aa, Homo sapiens; identical to SEQ ID NO: 31470
  ENSP00000447542

SEQ ID NO: 31473 - protein, 244 aa, Homo sapiens
  ENSP00000448286
  MOD_RES (1)..(1): Any amino acid
XELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 31474 - protein, 244 aa, Homo sapiens; identical to SEQ ID NO: 31470
  ENSP00000331787

SEQ ID NO: 31475 - protein, 243 aa, Homo sapiens
  ENSP00000454733
MDRKTTSWDTKFYEKWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKA

SEQ ID NO: 31476 - protein, 318 aa, Homo sapiens
  ENSP00000350874
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 31477 - protein, 317 aa, Homo sapiens
  ENSP00000379335
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGGKWEKPSEILEIKGQNWEEQVNSLPEVFRKAGFVIEAFTRLPYLCEGDMYNDYYVLDDAVFVLKPV

SEQ ID NO: 31478 - protein, 74 aa, Homo sapiens
  ENSP00000457311
MRLLAGWLCLSLASVWLARRMWTLRSPLTRSLYVNMTSGPGGPAAAAGGRKENHQVARKRLNVCVFTRSVSETA

SEQ ID NO: 31479 - protein, 61 aa, Homo sapiens
  ENSP00000456345
MRLLAGWLCLSLASVWLARRMWTLRSPLTRSLGMCATERNYANHSRLSLFRVTLIKEHRSS

SEQ ID NO: 31480 - protein, 139 aa, Homo sapiens
  ENSP00000454239
MSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVEN

SEQ ID NO: 31481 - protein, 125 aa, Homo sapiens
  ENSP00000455285
  MOD_RES (1)..(1): Any amino acid
XSYLDQGTQIFLNNSIEKSGWLFIQLYHSFVSSVFSLFMSRTSINGVLGINEWQNTGFQYDVISCLNLLDRCDQPLTLLKDIRSVLEPTRGRVILALVLPFHPYVENVGGKWEKPSEILEIKGQN

SEQ ID NO: 31482 - protein, 128 aa, Homo sapiens
  ENSP00000455720
  MOD_RES (1)..(1): Any amino acid
XPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGKCGQSG

SEQ ID NO: 31483 - protein, 282 aa, Homo sapiens
  ENSP00000480710
MWTLRSPLTRSLYVKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 31484 - protein, 318 aa, Homo sapiens; identical to SEQ ID NO: 31476
  ENSP00000491241

SEQ ID NO: 31485 - protein, 282 aa, Homo sapiens; identical to SEQ ID NO: 31483
  ENSP00000492687

SEQ ID NO: 31486 - protein, 317 aa, Homo sapiens; identical to SEQ ID NO: 31477
  ENSP00000491526

SEQ ID NO: 31487 - protein, 243 aa, Homo sapiens; identical to SEQ ID NO: 31475
  ENSP00000492407

SEQ ID NO: 31488 - protein, 125 aa, Homo sapiens; identical to SEQ ID NO: 31481
  ENSP00000491618
  MOD_RES (1)..(1): Any amino acid

SEQ ID NO: 31489 - protein, 128 aa, Homo sapiens; identical to SEQ ID NO: 31482
  ENSP00000491636
  MOD_RES (1)..(1): Any amino acid

SEQ ID NO: 31490 - protein, 139 aa, Homo sapiens; identical to SEQ ID NO: 31480
  ENSP00000492878

SEQ ID NO: 31491 - protein, 74 aa, Homo sapiens; identical to SEQ ID NO: 31478
  ENSP00000492569

SEQ ID NO: 31492 - protein, 61 aa, Homo sapiens; identical to SEQ ID NO: 31479
  ENSP00000492256

SEQ ID NO: 31493 - protein, 306 aa, Homo sapiens
  ENSP00000377307
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 31494 - protein, 409 aa, Homo sapiens
  ENSP00000354583
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 31495 - protein, 156 aa, Homo sapiens
  ENSP00000422791
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIME

SEQ ID NO: 31496 - protein, 63 aa, Homo sapiens
  ENSP00000423722
MHDSGLLNITKVSFSDRGKYTCVASNIYGTVNNTVTLRVIFTSGDMGVYYMVVCLVAFTIVMV

SEQ ID NO: 31497 - protein, 44 aa, Homo sapiens
  ENSP00000423802
MHDSGLLNITKVSFSDRGKYTCVASNIYGTVNNTVTLRVIFTSG

SEQ ID NO: 31498 - protein, 102 aa, Homo sapiens
  ENSP00000377305
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGRL

SEQ ID NO: 31499 - protein, 102 aa, Homo sapiens; identical to SEQ ID NO: 31498
  ENSP00000422571

SEQ ID NO: 31500 - protein, 98 aa, Homo sapiens
  ENSP00000425303
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERG

SEQ ID NO: 31501 - protein, 90 aa, Homo sapiens
  ENSP00000426247
MDRLKSHLTVCFLPSVPFLILVSTLATAKSVTNSTLNGTNVVLGSVPVIIARTDHIIVKEGNSALINCSVYGIPDPQFKWYNSIGKLLKE

SEQ ID NO: 31502 - protein, 73 aa, Homo sapiens
  ENSP00000423549
MDRLKSHLTVCFLPSVPFLILVSTLATAKSVTNSTLNGTNVVLGSVPVIIARTDHIIVKEGNSALINCSVYGI

SEQ ID NO: 31503 - protein, 32 aa, Homo sapiens
  ENSP00000390165
MAEISRIQYEMEYTEGISQRMRVPEKLKVAPP

SEQ ID NO: 31504 - protein, 291 aa, Homo sapiens
  ENSP00000304898
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 31505 - protein, 342 aa, Homo sapiens
  ENSP00000302037
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 31506 - protein, 218 aa, Homo sapiens
  ENSP00000346498
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 31507 - protein, 59 aa, Homo sapiens
  ENSP00000431725
MSENAVRQNGQLVRNDSLWHRSDSAPRNKISRFQAPISAPEYTVTPSPQQARVCPPHML

SEQ ID NO: 31508 - protein, 69 aa, Homo sapiens
  ENSP00000432447
MSENAVRQNGQLVRNDSLVTPSPQQARVCPPHMLPEDGANLSSARGILSLIQSSTRRAYQQILDVLDEN

SEQ ID NO: 31509 - protein, 218 aa, Homo sapiens; identical to SEQ ID NO: 31506
  ENSP00000386964

SEQ ID NO: 31510 - protein, 138 aa, Homo sapiens
  ENSP00000415996
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQN

SEQ ID NO: 31511 - protein, 238 aa, Homo sapiens
  ENSP00000386641
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 31512 - protein, 243 aa, Homo sapiens
  ENSP00000338412
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTYGISNIDTTIEGTSDDLTVVDAASLRRQIIKLNRRLQLLEEENKERAKREMVMYSITVAFWLLNSWLWFRR

SEQ ID NO: 31513 - protein, 52 aa, Homo sapiens
  ENSP00000436920
MAEISRIQYEMEYTEGISQRMRVPEKLKVAPPNADLEQGFQEGVPNASVIMQ

SEQ ID NO: 31514 - protein, 71 aa, Homo sapiens
  ENSP00000435354
MSENAVRQNGQLVRNDSLWHRSDSAPRNKISRFQAPISAPEYTYGISNIDTTIEGTSDDLTVVDAASLRRQ

SEQ ID NO: 31515 - protein, 89 aa, Homo sapiens
  ENSP00000436289
MSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 31516 - protein, 238 aa, Homo sapiens; identical to SEQ ID NO: 31511
  ENSP00000304134

SEQ ID NO: 31517 - protein, 34 aa, Homo sapiens
  ENSP00000411386
MSKGTSSDTSLGRVSRAAFPSPTAAEMAEISRIQ

SEQ ID NO: 31518 - protein, 71 aa, Homo sapiens
  ENSP00000391829
MSKGTSSDTSLGRVSRAAFPSPTAAEMAEISRIQYEMEYTEGISQRMRVPEKLKVAPPNADLEQGFQEGVP

SEQ ID NO: 31519 - protein, 60 aa, Homo sapiens
  ENSP00000407547
MAEISRIQYEMEYTEGISQRMRVPEKLKVAPPNADLEQGFQEGVPNASVIMQVPERIVVA

SEQ ID NO: 31520 - protein, 154 aa, Homo sapiens
  ENSP00000415313
IRAVGRLKRERSMSENAVRQNGQLVRNDSLVTPSPQQARVCPPHMLPEDGANLSSARGILSLIQSSTRRAYQQILDVLDENRRYGISNIDTTIEGTSDDLTVVDAASLRRQIIKLNRRLQLLEEENKERAKREMVMYSITVAFWLLNSWLWFRR

SEQ ID NO: 31521 - protein, 221 aa, Homo sapiens
  ENSP00000375912
MQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRYGISNIDTTIEGTSDDLTVVDAASLRRQIIKLNRRLQLLEEENKERAKREMVMYSITVAFWLLNSWLWFRR

SEQ ID NO: 31522 - protein, 25 aa, Homo sapiens
  ENSP00000452734
MPRPRLLAALCGALLCAPSLLVALG

SEQ ID NO: 31523 - protein, 335 aa, Homo sapiens
  ENSP00000268151
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 31524 - protein, 387 aa, Homo sapiens
  ENSP00000268150
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 31525 - protein, 387 aa, Homo sapiens; identical to SEQ ID NO: 31524
  ENSP00000456281

SEQ ID NO: 31526 - protein, 343 aa, Homo sapiens
  ENSP00000444332
MPRPRLLAALCGALLCAPSLLVALECVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 31527 - protein, 268 aa, Homo sapiens
  ENSP00000452926
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNAATRPGACISSAGTPPMHGWTSRATSTPGLRGATVTISGC

SEQ ID NO: 31528 - protein, 75 aa, Homo sapiens
  ENSP00000478952
FDFIHDVNKKHKEFVGNWNKNAVHVNLFETPVEAQYVRLYPTSCHTACTLRFELLGCELNARKADLRRGADDREQ

SEQ ID NO: 31529 - protein, 1052 aa, Homo sapiens
  ENSP00000276282
MAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPLGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKKNVGEKHRNQ

SEQ ID NO: 31530 - protein, 530 aa, Homo sapiens
  ENSP00000361898
MAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 31531 - protein, 266 aa, Homo sapiens
  ENSP00000407606
MAKGEGAESGSAAGLLPTSILQSTERPAQKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQR

SEQ ID NO: 31532 - protein, 543 aa, Homo sapiens
  ENSP00000361895
MAKGEGAESGSAAGLLPTSILQSTERPAQVKKEPKKKKQQLSVCNKLCYALGGAPYQVTGCALGFFLQIYLLDVAQKDEEVVFCFSSFQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 31533 - protein, 374 aa, Homo sapiens
  ENSP00000391261
MVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 31534 - protein, 474 aa, Homo sapiens
  ENSP00000258436
MELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 31535 - protein, 92 aa, Homo sapiens
  ENSP00000408630
MELGGHWDMNSAPRLVSETAERKQEQKTGTEAEAADSGAVGARRFLLCLYLVGFLDLFGVSMVVPLLSLHVKSLGASPTVAGIVDDVCSKRF

SEQ ID NO: 31536 - protein, 98 aa, Homo sapiens
  ENSP00000414870
MELGGHWDMNSAPRLVSETAERKQEQKTGTEAEAADSGAVGARRFLLCLYLVGFLHGCAFIEPSCQVPWSKSNSCWNSRRRMFKEILRFEHYNQVPCH

SEQ ID NO: 31537 - protein, 92 aa, Homo sapiens; identical to SEQ ID NO: 31535
  ENSP00000392605

SEQ ID NO: 31538 - protein, 79 aa, Homo sapiens
  ENSP00000413641
TVAGIVGSSYGILQLFSSTLVGCWSDVVGRRSSLLACILLSALGYLLLGAATNVFLFVLARVPAGLYFLMWFQRRNGRL

SEQ ID NO: 31539 - protein, 66 aa, Homo sapiens
  ENSP00000402411
MELGGHWDMNSAPRLVSETAERKQEQKTGTEAEAADSGAVGARRFLLCLYLVGFLVSASVGAGSKC

SEQ ID NO: 31540 - protein, 533 aa, Homo sapiens
  ENSP00000345270
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 31541 - protein, 161 aa, Homo sapiens
  ENSP00000416226
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGG

SEQ ID NO: 31542 - protein, 108 aa, Homo sapiens
  ENSP00000408075
MESCSCHPGSGVQWRDHGSLQLPPPGFKMKMRRYKLFLMFCMAGLCLISFLHFFKTLSYVTFPRELASLSPNLVSSFFWNNAPVTPQASPEPGGPDLLRTPLYSHSPL

SEQ ID NO: 31543 - protein, 478 aa, Homo sapiens
  ENSP00000481096
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGNFEMSGVNQKIPFDIHCMRIYVTKTQKEWLIIRSISIWTS

SEQ ID NO: 31544 - protein, 478 aa, Homo sapiens; identical to SEQ ID NO: 31543
  ENSP00000477650

SEQ ID NO: 31545 - protein, 478 aa, Homo sapiens; identical to SEQ ID NO: 31543
  ENSP00000478300

SEQ ID NO: 31546 - protein, 478 aa, Homo sapiens; identical to SEQ ID NO: 31543
  ENSP00000446647

SEQ ID NO: 31547 - protein, 397 aa, Homo sapiens
  ENSP00000449172
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTG

SEQ ID NO: 31548 - protein, 111 aa, Homo sapiens
  ENSP00000448093
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKPHGLLFIIQRDGE

SEQ ID NO: 31549 - protein, 478 aa, Homo sapiens; identical to SEQ ID NO: 31543
  ENSP00000447253

SEQ ID NO: 31550 - protein, 478 aa, Homo sapiens; identical to SEQ ID NO: 31543
  ENSP00000490547

SEQ ID NO: 31551 - protein, 478 aa, Homo sapiens; identical to SEQ ID NO: 31543
  ENSP00000489751

SEQ ID NO: 31552 - protein, 478 aa, Homo sapiens; identical to SEQ ID NO: 31543
  ENSP00000490784

SEQ ID NO: 31553 - protein, 478 aa, Homo sapiens; identical to SEQ ID NO: 31543
  ENSP00000490416

SEQ ID NO: 31554 - protein, 478 aa, Homo sapiens; identical to SEQ ID NO: 31543
  ENSP00000489618

SEQ ID NO: 31555 - protein, 397 aa, Homo sapiens; identical to SEQ ID NO: 31547
  ENSP00000489858

SEQ ID NO: 31556 - protein, 111 aa, Homo sapiens; identical to SEQ ID NO: 31548
  ENSP00000490212

SEQ ID NO: 31557 - protein, 790 aa, Homo sapiens
  ENSP00000301618
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 31558 - protein, 792 aa, Homo sapiens
  ENSP00000456037
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 31559 - protein, 110 aa, Homo sapiens
  ENSP00000457614
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADR

SEQ ID NO: 31560 - protein, 801 aa, Homo sapiens
  ENSP00000391227
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 31561 - protein, 483 aa, Homo sapiens
  ENSP00000455631
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFREGEVPGHPEQIHGDPWHRVLREPAAPRGASLCEEPRPLTAA

SEQ ID NO: 31562 - protein, 303 aa, Homo sapiens
  ENSP00000402798
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31563 - protein, 209 aa, Homo sapiens
  ENSP00000417060
  MOD_RES (1)..(1): Any amino acid
XLQGGAIAILTAAERPGHFAGMVLISPLVLANPESATTFKDYSRILKHLMEKASRMLKFWIPRPFWVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31564 - protein, 155 aa, Homo sapiens [sequence omitted]

SEQ ID NO: 31565 - protein, 277 aa, Homo sapiens
  ENSP00000381173
MQTRFRRIFPWKDASTKRMPEFIHFSPLKPYKGREWEKAGSEHVLETHLLPVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31566 - protein, 197 aa, Homo sapiens
  ENSP00000419340
PVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31567 - protein, 89 aa, Homo sapiens
  ENSP00000417689
MLMGLDLLVFAHDHVGHGQSEGERMVVSDFHVFVRDVLQHVDSMQKDYPGLPVFLLGHSMGGAIAILTAAERPGHFAGMVLISPLVLAN

SEQ ID NO: 31568 - protein, 77 aa, Homo sapiens
  ENSP00000417489
MPEESSPRRTPQSIPYQDLPHLVNADGQYLFCRYWKPTGTPKALIFVSHGAGEHSGRYEELARMLMGLDLLVFAHDH

SEQ ID NO: 31569 - protein, 313 aa, Homo sapiens
  ENSP00000265052
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31570 - protein, 303 aa, Homo sapiens; identical to SEQ ID NO: 31562
  ENSP00000381176

SEQ ID NO: 31571 - protein, 283 aa, Homo sapiens
  ENSP00000404146
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 31572 - protein, 103 aa, Homo sapiens
  ENSP00000445907
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 31573 - protein, 74 aa, Homo sapiens
  ENSP00000445436
  MOD_RES (1)..(1): Any amino acid
XSHESMESYELRSENALSLSTSSIGKPVMTTDFANATPWFMDTMLPIIATSGSAEGPNETEGRKKISFFLEAGT

SEQ ID NO: 31574 - protein, 128 aa, Homo sapiens
  ENSP00000228938
MKSLILLAILAALAVVTLCYGEWQKEENFGFDIVSVLSLNWHRAQESHESMESYELNPFINRRNANTFISPQQRWRAKVQERIRERSKPVHELNREACDDYRLCERYAMVYGYNAAYNRYFRKRRGTK

SEQ ID NO: 31575 - protein, 77 aa, Homo sapiens
  ENSP00000442557
MVDLTQVMDDEVFMAFASYATIILSKMMLMSTATAFYRLTRKVFANPEDCVAFGKGENAKKYLRTDDRVERVRRAHL

SEQ ID NO: 31576 - protein, 106 aa, Homo sapiens
  ENSP00000442767
MVDLTQVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTL

SEQ ID NO: 31577 - protein, 155 aa, Homo sapiens
  ENSP00000379513
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 31578 - protein, 87 aa, Homo sapiens
  ENSP00000438308
MVDLTQVMDDEVFMAFASYATIILSKMMLMSTATAFYRLTRKVFANPEDCVAFGKGENAKKYLRTDDRVERVRRIKQTLSIYLASSI

SEQ ID NO: 31579 - protein, 46 aa, Homo sapiens
  ENSP00000437988
MVDLTQVMDDEVFMAFASYATIILSKMMLMSTATAFYRLTRKSPPE

SEQ ID NO: 31580 - protein, 80 aa, Homo sapiens
  ENSP00000442970
MVDLTQVMDDEVFMAFASYATIILSKMMLMSTATAFYRLTRKVFANPEDCVAFGKGENAKKYLRTDDRVERVRRAHLNDL

SEQ ID NO: 31581 - protein, 42 aa, Homo sapiens
  ENSP00000440443
MVDLTQVMDDEVFMAFASYATIILSKMMLMSTATAFYRLTRK

SEQ ID NO: 31582 - protein, 155 aa, Homo sapiens; identical to SEQ ID NO: 31577
  ENSP00000379510

SEQ ID NO: 31583 - protein, 155 aa, Homo sapiens; identical to SEQ ID NO: 31577
  ENSP00000010404

SEQ ID NO: 31584 - protein, 155 aa, Homo sapiens; identical to SEQ ID NO: 31577
  ENSP00000379512

SEQ ID NO: 31585 - protein, 98 aa, Homo sapiens
  ENSP00000434209
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCG

SEQ ID NO: 31586 - protein, 88 aa, Homo sapiens
  ENSP00000435270
MGENEDEKQAQAGQVFENFVQASTCKGTLQAFNILTRHLDLDPLDHRNFYSKLKSKVTTWKAKALWYKLDKRGSHKEYKRGKSCTNTK

SEQ ID NO: 31587 - protein, 1124 aa, Homo sapiens
  ENSP00000256194
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 31588 - protein, 3 aa, Homo sapiens
  ENSP00000434957
MGE

SEQ ID NO: 31589 - protein, 88 aa, Homo sapiens; identical to SEQ ID NO: 31586
  ENSP00000433818

SEQ ID NO: 31590 - protein, 934 aa, Homo sapiens
  ENSP00000433965
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 31591 - protein, 120 aa, Homo sapiens
  ENSP00000437229
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDS

SEQ ID NO: 31592 - protein, 134 aa, Homo sapiens
  ENSP00000433509
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTI

SEQ ID NO: 31593 - protein, 101 aa, Homo sapiens
  ENSP00000433357
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRT

SEQ ID NO: 31594 - protein, 976 aa, Homo sapiens
  ENSP00000368932
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 31595 - protein, 1103 aa, Homo sapiens
  ENSP00000344894
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 31596 - protein, 1124 aa, Homo sapiens; identical to SEQ ID NO: 31587
  ENSP00000441689

SEQ ID NO: 31597 - protein, 29 aa, Homo sapiens
  ENSP00000432324
MSPPKDPSPSLPLPSSSSHSSSPPSSSST

SEQ ID NO: 31598 - protein, 695 aa, Homo sapiens
  ENSP00000256186
MSPPKDPSPSLPLPSSSSHSSSPPSSSSTSVSGNAPDGSSPPQMTASEPLSQVSRGHPSPPTPNFRRRAVAQGAPREIPLYLPHHPKPEWAEYCLVSPGEDGLSDPAEMTSDECQPAEAPLGDIGSNHRDPHPIWGKDRSWTGQELSPLAGEDREKGSTGARKEEEGGPVLVKEKLGLKKLVLTQEQKTMLLDWNDSIPESVHLKAGERISQKSAENGRGGRVLKPVRPLLLPRAAGEPLPTQRGAQEKMGTPAEQAQGERNVPPPKSPLRLIANAIRRSLEPLLSNSEGGKKAWAKQESKTLPAQACTRSFSLRKTNSNKDGDQHSPGRNQSSAFSPPDPALRTHSLPNRPSKVFPALRSPPCSKIEDVPTLLEKVSLQENFPDASKPPKKRISLFSSLRLKDKSFESFLQESRQRKDIRDLFGSPKRKVLPEDSAQALEKLLQPFKSTSLRQAAPPPPPPPPPPPPPPTAGGADSKNFPLRAQVTEASSSASSTSSSSADEEFDPQLSLQLKEKKTLRRRKKLEKAMKQLVKQEELKRLYKAQAIQRQLEEVEERQRASEIQGVRLEKALRGEADSGTQDEAQLLQEWFKLVLEKNKLMRYESELLIMAQELELEDHQSRLEQKLREKMLKEESQKDEKDLNEEQEVFTELMQVIEQRDKLVDSLEEQRIREKAEDQHFESFVFSRGCQLSRT

SEQ ID NO: 31599 - protein, 667 aa, Homo sapiens
  ENSP00000370156
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 31600 - protein, 667 aa, Homo sapiens; identical to SEQ ID NO: 31599
  ENSP00000370157

SEQ ID NO: 31601 - protein, 667 aa, Homo sapiens; identical to SEQ ID NO: 31599
  ENSP00000370162

SEQ ID NO: 31602 - protein, 667 aa, Homo sapiens; identical to SEQ ID NO: 31599
  ENSP00000370164

SEQ ID NO: 31603 - protein, 552 aa, Homo sapiens
  ENSP00000370159
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTW

SEQ ID NO: 31604 - protein, 483 aa, Homo sapiens
  ENSP00000391154
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNS

SEQ ID NO: 31605 - protein, 197 aa, Homo sapiens
  ENSP00000387771
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICAL

SEQ ID NO: 31606 - protein, 667 aa, Homo sapiens; identical to SEQ ID NO: 31599
  ENSP00000414521

SEQ ID NO: 31607 - protein, 228 aa, Homo sapiens
  ENSP00000483707
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKQNLESNLTNLIKRNTELETLLAKLIQTCQHVELECSVLFPRVAQWG

SEQ ID NO: 31608 - protein, 540 aa, Homo sapiens
  ENSP00000484712
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVETVKDQKVIGREKQQYYPRNRRKWVSNSLQARLMGRRCISRRERKLTLDVEKVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSEYLMAYLFLSLVAFFRLIAFLNLNFKGRQGRKEHTIFIDLSFLNKKVIALTCTTLVKTAG

SEQ ID NO: 31609 - protein, 667 aa, Homo sapiens; identical to SEQ ID NO: 31599
  ENSP00000312678

SEQ ID NO: 31610 - protein, 218 aa, Homo sapiens
  ENSP00000410730
METLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEK

SEQ ID NO: 31611 - protein, 735 aa, Homo sapiens
  ENSP00000262843
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISKSWCSWGLWPEIRKCKEAVSCSRLAGAPRGLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 31612 - protein, 705 aa, Homo sapiens
  ENSP00000413976
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 31613 - protein, 216 aa, Homo sapiens
  ENSP00000466895
MEPQPGGARSCRRGAPGGACELGPAAEAAPMSLAIHSTTGTRYDLAVPPDETVEGLRKRLSQRLKVPKERLALLHKDTRLSSGKLQEFGVGDGSKLTLVPTVEAGLMSQASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPI

SEQ ID NO: 31614 - protein, 468 aa, Homo sapiens
  ENSP00000467679
MEPQPGGARSCRRGAPGGACELGPAAEAAPMSLAIHSTTGTRYDLAVPPDETVEGLRKRLSQRLKVPKERLALLHKDTRLSSGKLQEFGVGDGSKLTLVPTVEAGLMSQASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPITAGSFRSHAASTTCPEQMDCSPTASSSASPGASTTSTPGASPAPRSRKPGAVIESFVNHAPGVFSGTFSGTLHPNCQDSSGRPRRDIGTILQILNDLLSATRHYQGMPPSLAQLRCHAQCSPASPAPDLAPRTTSCEKLTAAPSASLLQGQSQIRMCKPPGDRLRQTENRATRCKVERLQLLLQQKRLRRKARRDARGPYHWSPSRKAGRSDSSSSGGGGSPSEASGLGLDFEDSVWKPEVNPDIKSEFVVA

SEQ ID NO: 31615 - protein, 139 aa, Homo sapiens
  ENSP00000466835
  MOD_RES (1)..(1): Any amino acid
XRLSSGKLQEFGVGDGSKLTLVPTVEAGLMSQASRPEQSVMQALESLTETQPPAAPGPGRAGGGGFRKYRFILFKRPWHRQGPQSPERGGERPQVSDFLSGRSPLTLALRVGDHMMFVQLQLAAQHAPLQHRHVLAAAA

SEQ ID NO: 31616 - protein, 468 aa, Homo sapiens; identical to SEQ ID NO: 31614
  ENSP00000300952

SEQ ID NO: 31617 - protein, 352 aa, Homo sapiens
  ENSP00000364946
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTDTLENGSNKGESAANRKGPSKDDTYWKEINAAMALTNLAQGKDKLQGTTSCIIQKSSHIAEVKTVKVPLVQQF

SEQ ID NO: 31618 - protein, 290 aa, Homo sapiens
  ENSP00000452751
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTVENLGSLSEDS

SEQ ID NO: 31619 - protein, 58 aa, Homo sapiens
  ENSP00000453746
MNTIVFNKLSGAVLFEDGGASERERGGRPYSGVLDSPHARPEVGIPDGPPLKDNLGLR

SEQ ID NO: 31620 - protein, 352 aa, Homo sapiens; identical to SEQ ID NO: 31617
  ENSP00000400896

SEQ ID NO: 31621 - protein, 377 aa, Homo sapiens
  ENSP00000379216
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 31622 - protein, 377 aa, Homo sapiens; identical to SEQ ID NO: 31621
  ENSP00000310375

SEQ ID NO: 31623 - protein, 223 aa, Homo sapiens
  ENSP00000401385
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECP

SEQ ID NO: 31624 - protein, 90 aa, Homo sapiens
  ENSP00000357917
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 31625 - protein, 493 aa, Homo sapiens
  ENSP00000262430
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 31626 - protein, 193 aa, Homo sapiens
  ENSP00000385963
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMAGKLRPGMTCLKRQ

SEQ ID NO: 31627 - protein, 270 aa, Homo sapiens
  ENSP00000384690
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERTGSCVQFLRGEACPKAGTACLPARYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 31628 - protein, 246 aa, Homo sapiens
  ENSP00000384141
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 31629 - protein, 193 aa, Homo sapiens; identical to SEQ ID NO: 31626
  ENSP00000484193

SEQ ID NO: 31630 - protein, 71 aa, Homo sapiens
  ENSP00000450323
MSPAPRPPRCLLLPLLTLGTALASLGSAQSSSFSPESLEELYNWGELPLPRFPWALLSALEPPDKHLDSAQ

SEQ ID NO: 31631 - protein, 194 aa, Homo sapiens
  ENSP00000446989
MRESLLFLRLPSSPALSRRRALRWALRPPRVAQAFSGRVCGQAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGD

SEQ ID NO: 31632 - protein, 582 aa, Homo sapiens
  ENSP00000308208
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 31633 - protein, 669 aa, Homo sapiens
  ENSP00000219271
MGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 31634 - protein, 97 aa, Homo sapiens
  ENSP00000457084
  MOD_RES (1)..(1): Any amino acid
XSTDLHGNNLFLVAVHELGHALGLEHSSNPNAIMAPFYQWKDVDNFKLPEDDLRGIQQLYGAWAVTSGLCMPLSSPWPMRSRHCCHPHFVDEEPKAQ

SEQ ID NO: 31635 - protein, 607 aa, Homo sapiens
  ENSP00000286614
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 31636 - protein, 168 aa, Homo sapiens
  ENSP00000429147
MRDGRYCRRAVLKPGPLSRAGYLRTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKA

SEQ ID NO: 31637 - protein, 584 aa, Homo sapiens
  ENSP00000461421
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 31638 - protein, 118 aa, Homo sapiens
  ENSP00000457949
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHA

SEQ ID NO: 31639 - protein, 660 aa, Homo sapiens
  ENSP00000219070
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 31640 - protein, 201 aa, Homo sapiens
  ENSP00000456096
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHE

SEQ ID NO: 31641 - protein, 584 aa, Homo sapiens; identical to SEQ ID NO: 31637
  ENSP00000444143

SEQ ID NO: 31642 - protein, 610 aa, Homo sapiens
  ENSP00000394237
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 31643 - protein, 251 aa, Homo sapiens
  ENSP00000456518
GTTEDYDRDKKYGFCPETGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGG

SEQ ID NO: 31644 - protein, 22 aa, Homo sapiens
  ENSP00000461915
  MOD_RES (1)..(1): Any amino acid
XLENQSLKSVKFGSIKSDWLGC

SEQ ID NO: 31645 - protein, 645 aa, Homo sapiens
  ENSP00000246186
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 31646 - protein, 495 aa, Homo sapiens
  ENSP00000260453
MGSKRRNLSCSERHQKLVDENYCKKLHVQALKNVNSQIRNQMVQNENDNRVQRKQFLRLLQNEQFELDMEEAIQKAEENKRLKELQLKQEEKLAMELAKLKHESLKDEKMRQQVRENSIELRELEKKLKAAYMNKERAAQIAEKDAIKYEQMKRDAEIAKTMMEEHKRIIKEENAAEDKRNKAKAQYYLDLEKQLEEQEKKKQEAYEQLLKEKLMIDEIVRKIYEEDQLEKQQKLEKMNAMRRYIEEFQKEQALWRKKKREEMEEENRKIIEFANMQQQREEDRMAKVQENEEKRLQLQNALTQKLEEMLRQREDLEQVRQELYQEEQAEIYKSKLKEEAEKKLRKQKEMKQDFEEQMALKELVLQAAKEEEENFRKTMLAKFAEDDRIELMNAQKQRMKQLEHRRAVEKLIEERRQQFLADKQRELEEWQLQQRRQGFINAIIEEERLKLLKEHATNLLGYLPKGVFKKEDDIDLLGEEFRKVYQQRSEICEEK

SEQ ID NO: 31647 - protein, 58 aa, Homo sapiens
  ENSP00000410720
MSQKPAKEGPRLSKNQKYSEHFSIHCCPPFTFLNSKKEIVDRKYSICKSGCFYQKKEE

SEQ ID NO: 31648 - protein, 81 aa, Homo sapiens
  ENSP00000401312
MSQKPAKEGPRLSKNQKYSEHFSIHCCPPFTFLNSKKEIVDRKYSICKSGCFYQKKEEDWICCACQKTRLKRKIRPTPKKK

SEQ ID NO: 31649 - protein, 183 aa, Homo sapiens
  ENSP00000400491
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRFW

SEQ ID NO: 31650 - protein, 81 aa, Homo sapiens; identical to SEQ ID NO: 31648
  ENSP00000388148

SEQ ID NO: 31651 - protein, 81 aa, Homo sapiens; identical to SEQ ID NO: 31648
  ENSP00000409730

SEQ ID NO: 31652 - protein, 81 aa, Homo sapiens; identical to SEQ ID NO: 31648
  ENSP00000373261

SEQ ID NO: 31653 - protein, 62 aa, Homo sapiens
  ENSP00000409071
MSVDIPLPTSEMSQKPAKEGPRLSKNQKYSEHFSIHCCPPFTFLNSKKEIVDRKYSICKSGC

SEQ ID NO: 31654 - protein, 183 aa, Homo sapiens; identical to SEQ ID NO: 31649
  ENSP00000388827

SEQ ID NO: 31655 - protein, 206 aa, Homo sapiens
  ENSP00000312293
MSQKPAKEGPRLSKNQKYSEHFSIHCCPPFTFLNSKKEIVDRKYSICKSGCFYQKKEEDWICCACQKTSSCQRRLSSRGEPWLPPPASFGPLRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 31656 - protein, 81 aa, Homo sapiens; identical to SEQ ID NO: 31648
  ENSP00000405549

SEQ ID NO: 31657 - protein, 183 aa, Homo sapiens; identical to SEQ ID NO: 31649
  ENSP00000389055

SEQ ID NO: 31658 - protein, 182 aa, Homo sapiens
  ENSP00000413771
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 31659 - protein, 247 aa, Homo sapiens
  ENSP00000401609
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 31660 - protein, 295 aa, Homo sapiens [sequence omitted]

SEQ ID NO: 31661 - protein, 179 aa, Homo sapiens
  ENSP00000408039
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELRNPF

SEQ ID NO: 31662 - protein, 252 aa, Homo sapiens
  ENSP00000402363
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELLFHLEALSG

SEQ ID NO: 31663 - protein, 229 aa, Homo sapiens [sequence omitted]

SEQ ID NO: 31664 - protein, 213 aa, Homo sapiens
  ENSP00000391516
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELLFHLEALSG

SEQ ID NO: 31665 - protein, 204 aa, Homo sapiens
  ENSP00000415883
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFVFHLEALSG

SEQ ID NO: 31666 - protein, 131 aa, Homo sapiens [sequence omitted]

SEQ ID NO: 31667 - protein, 224 aa, Homo sapiens [sequence omitted]

SEQ ID NO: 31668 - protein, 208 aa, Homo sapiens [sequence omitted]

SEQ ID NO: 31669 - protein, 247 aa, Homo sapiens
  ENSP00000366115
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 31670 - protein, 45 aa, Homo sapiens
  ENSP00000366101
MASLSRPSLPSCLCSFLLLLLLQVSSSYAVQSDRTKTPYPGSGRG

SEQ ID NO: 31671 - protein, 131 aa, Homo sapiens
  ENSP00000366085
MASLSRPSLPSCLCSFLLLLLLQVSSSYADPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 31672 - protein, 295 aa, Homo sapiens
  ENSP00000366091
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 31673 - protein, 224 aa, Homo sapiens
  ENSP00000379932
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELRNPF

SEQ ID NO: 31674 - protein, 92 aa, Homo sapiens
  ENSP00000418090
MASLSRPSLPSCLCSFLLLLLLQVSSSYADPFYWVSPGVLVLLAVLPVLLLQITVGLIFLCLQYRLRGKLRAEIENLHRTFGQFLEELRNPF

SEQ ID NO: 31675 - protein, 108 aa, Homo sapiens
  ENSP00000420350
MASLSRPSLPSCLCSFLLLLLLQVSSSYADPFYWVSPGVLVLLAVLPVLLLQITVGLIFLCLQYRLRGKLRAEIENLHRTFESFGVLGPQVKEPKKTGQFLEELRNPF

SEQ ID NO: 31676 - protein, 209 aa, Homo sapiens
  ENSP00000409394
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEGKLRAEIENLHRTFDPHFLRVPCWKITLFVIVPVLGPLVALIICYNWLHRRLAGQFLEELRNPF

SEQ ID NO: 31677 - protein, 206 aa, Homo sapiens
  ENSP00000366088
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFVFHLEALSG

SEQ ID NO: 31678 - protein, 252 aa, Homo sapiens
  ENSP00000366095
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELLFHLEALSG

SEQ ID NO: 31679 - protein, 213 aa, Homo sapiens
  ENSP00000379929
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELLFHLEALSG

SEQ ID NO: 31680 - protein, 229 aa, Homo sapiens
  ENSP00000417405
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELLFHLEALSG

SEQ ID NO: 31681 - protein, 208 aa, Homo sapiens
  ENSP00000410866
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELRNPF

SEQ ID NO: 31682 - protein, 142 aa, Homo sapiens
  ENSP00000418872
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 31683 - protein, 142 aa, Homo sapiens; identical to SEQ ID NO: 31682
  ENSP00000366086
  MOD_RES (1)..(1): Any amino acid

SEQ ID NO: 31684 - protein, 247 aa, Homo sapiens; identical to SEQ ID NO: 31659
  ENSP00000389221

SEQ ID NO: 31685 - protein, 295 aa, Homo sapiens [sequence omitted]

SEQ ID NO: 31686 - protein, 131 aa, Homo sapiens [sequence omitted]

SEQ ID NO: 31687 - protein, 252 aa, Homo sapiens; identical to SEQ ID NO: 31662
  ENSP00000395304

SEQ ID NO: 31688 - protein, 213 aa, Homo sapiens; identical to SEQ ID NO: 31664
  ENSP00000398197

SEQ ID NO: 31689 - protein, 229 aa, Homo sapiens [sequence omitted]

SEQ ID NO: 31690 - protein, 224 aa, Homo sapiens [sequence omitted]

SEQ ID NO: 31691 - protein, 204 aa, Homo sapiens; identical to SEQ ID NO: 31665
  ENSP00000399240

SEQ ID NO: 31692 - protein, 179 aa, Homo sapiens; identical to SEQ ID NO: 31661
  ENSP00000401457
  MOD_RES (1)..(1): Any amino acid

SEQ ID NO: 31693 - protein, 208 aa, Homo sapiens [sequence omitted]

SEQ ID NO: 31694 - protein, 131 aa, Homo sapiens [sequence omitted]

SEQ ID NO: 31695 - protein, 204 aa, Homo sapiens; identical to SEQ ID NO: 31665
  ENSP00000397723

SEQ ID NO: 31696 - protein, 252 aa, Homo sapiens; identical to SEQ ID NO: 31662
  ENSP00000396344

SEQ ID NO: 31697 - protein, 179 aa, Homo sapiens; identical to SEQ ID NO: 31661
  ENSP00000392661
  MOD_RES (1)..(1): Any amino acid

SEQ ID NO: 31698 - protein, 213 aa, Homo sapiens; identical to SEQ ID NO: 31664
  ENSP00000390682

SEQ ID NO: 31699 - protein, 229 aa, Homo sapiens [sequence omitted]

SEQ ID NO: 31700 - protein, 247 aa, Homo sapiens; identical to SEQ ID NO: 31659
  ENSP00000404537

SEQ ID NO: 31701 - protein, 224 aa, Homo sapiens [sequence omitted]

SEQ ID NO: 31702 - protein, 295 aa, Homo sapiens [sequence omitted]

SEQ ID NO: 31703 - protein, 208 aa, Homo sapiens [sequence omitted]

SEQ ID NO: 31704 - protein, 247 aa, Homo sapiens; identical to SEQ ID NO: 31659
  ENSP00000373017

SEQ ID NO: 31705 - protein, 295 aa, Homo sapiens [sequence omitted]

SEQ ID NO: 31706 - protein, 131 aa, Homo sapiens [sequence omitted]

SEQ ID NO: 31707 - protein, 213 aa, Homo sapiens; identical to SEQ ID NO: 31664
  ENSP00000383512

SEQ ID NO: 31708 - protein, 252 aa, Homo sapiens; identical to SEQ ID NO: 31662
  ENSP00000400564

SEQ ID NO: 31709 - protein, 229 aa, Homo sapiens [sequence omitted]

SEQ ID NO: 31710 - protein, 224 aa, Homo sapiens [sequence omitted]

SEQ ID NO: 31711 - protein, 204 aa, Homo sapiens; identical to SEQ ID NO: 31665
  ENSP00000397837

SEQ ID NO: 31712 - protein, 179 aa, Homo sapiens; identical to SEQ ID NO: 31661
  ENSP00000403235
  MOD_RES (1)..(1): Any amino acid

SEQ ID NO: 31713 - protein, 208 aa, Homo sapiens [sequence omitted]

SEQ ID NO: 31714 - protein, 247 aa, Homo sapiens; identical to SEQ ID NO: 31659
  ENSP00000414489

SEQ ID NO: 31715 - protein, 295 aa, Homo sapiens [sequence omitted]

SEQ ID NO: 31716 - protein, 131 aa, Homo sapiens [sequence omitted]

SEQ ID NO: 31717 - protein, 252 aa, Homo sapiens; identical to SEQ ID NO: 31662
  ENSP00000404362

SEQ ID NO: 31718 - protein, 213 aa, Homo sapiens; identical to SEQ ID NO: 31664
  ENSP00000409534

SEQ ID NO: 31719 - protein, 229 aa, Homo sapiens [sequence omitted]

SEQ ID NO: 31720 - protein, 224 aa, Homo sapiens [sequence omitted]

SEQ ID NO: 31721 - protein, 204 aa, Homo sapiens; identical to SEQ ID NO: 31665
  ENSP00000413370

SEQ ID NO: 31722 - protein, 179 aa, Homo sapiens; identical to SEQ ID NO: 31661
  ENSP00000407143
  MOD_RES (1)..(1): Any amino acid

SEQ ID NO: 31723 - protein, 208 aa, Homo sapiens [sequence omitted]

SEQ ID NO: 31724 - protein, 131 aa, Homo sapiens
  ENSP00000387448
MASLSRPSLPSCLCSFLLLLLLQVSSSYADPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 31725 - protein, 204 aa, Homo sapiens
  ENSP00000395146
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFVFHLEALSG

SEQ ID NO: 31726 - protein, 252 aa, Homo sapiens
  ENSP00000400681
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELLFHLEALSG

SEQ ID NO: 31727 - protein, 179 aa, Homo sapiens
  ENSP00000406627
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELRNPF

SEQ ID NO: 31728 - protein, 213 aa, Homo sapiens
  ENSP00000402247
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELLFHLEALSG

SEQ ID NO: 31729 - protein, 229 aa, Homo sapiens
  ENSP00000420250
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELLFHLEALSG

SEQ ID NO: 31730 - protein, 247 aa, Homo sapiens
  ENSP00000389022
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 31731 - protein, 224 aa, Homo sapiens
  ENSP00000383509
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELRNPF

SEQ ID NO: 31732 - protein, 295 aa, Homo sapiens
  ENSP00000390785
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 31733 - protein, 130 aa, Homo sapiens
  ENSP00000491870
MASLSRPSLPSCLCSFLLLLLLQVSSSYADPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRKF

SEQ ID NO: 31734 - protein, 204 aa, Homo sapiens; identical to SEQ ID NO: 31665
  ENSP00000383528

SEQ ID NO: 31735 - protein, 229 aa, Homo sapiens [sequence omitted]

SEQ ID NO: 31736 - protein, 213 aa, Homo sapiens; identical to SEQ ID NO: 31664
  ENSP00000352534

SEQ ID NO: 31737 - protein, 179 aa, Homo sapiens; identical to SEQ ID NO: 31661
  ENSP00000383525
  MOD_RES (1)..(1): Any amino acid

SEQ ID NO: 31738 - protein, 131 aa, Homo sapiens [sequence omitted]

SEQ ID NO: 31739 - protein, 247 aa, Homo sapiens; identical to SEQ ID NO: 31659
  ENSP00000373126

SEQ ID NO: 31740 - protein, 295 aa, Homo sapiens [sequence omitted]

SEQ ID NO: 31741 - protein, 252 aa, Homo sapiens; identical to SEQ ID NO: 31662
  ENSP00000394156

SEQ ID NO: 31742 - protein, 224 aa, Homo sapiens [sequence omitted]

SEQ ID NO: 31743 - protein, 208 aa, Homo sapiens [sequence omitted]

SEQ ID NO: 31744 - protein, 288 aa, Homo sapiens
  ENSP00000353643
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 31745 - protein, 288 aa, Homo sapiens; identical to SEQ ID NO: 31744
  ENSP00000391969

SEQ ID NO: 31746 - protein, 177 aa, Homo sapiens
  ENSP00000413664
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEY

SEQ ID NO: 31747 - protein, 177 aa, Homo sapiens; identical to SEQ ID NO: 31746
  ENSP00000393283

SEQ ID NO: 31748 - protein, 158 aa, Homo sapiens
  ENSP00000400938
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAI

SEQ ID NO: 31749 - protein, 67 aa, Homo sapiens
  ENSP00000408607
MSSRKQGSQPRGQQSAEEENFKKPTRSNMQRSKMRGASSGKKTAGPQQKNLEPALPGRWGGRSAENP

SEQ ID NO: 31750 - protein, 288 aa, Homo sapiens; identical to SEQ ID NO: 31744
  ENSP00000394417

SEQ ID NO: 31751 - protein, 288 aa, Homo sapiens; identical to SEQ ID NO: 31744
  ENSP00000415476

SEQ ID NO: 31752 - protein, 288 aa, Homo sapiens; identical to SEQ ID NO: 31744
  ENSP00000410532

SEQ ID NO: 31753 - protein, 237 aa, Homo sapiens
  ENSP00000416120
MRGASSGKKTAGPQQKNLESVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 31754 - protein, 471 aa, Homo sapiens
  ENSP00000262966
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 31755 - protein, 451 aa, Homo sapiens
  ENSP00000353015
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 31756 - protein, 501 aa, Homo sapiens
  ENSP00000471735
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 31757 - protein, 419 aa, Homo sapiens
  ENSP00000470987
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEVPIPVQS

SEQ ID NO: 31758 - protein, 503 aa, Homo sapiens
  ENSP00000471715
GGPSGAEARGAGLQGRGAAEPWGERPPCSLSLSAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 31759 - protein, 469 aa, Homo sapiens
  ENSP00000471189
  MOD_RES (1)..(1): Any amino acid
XEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 31760 - protein, 121 aa, Homo sapiens
  ENSP00000469230
RPLGKSPSEPAHPEATTPGKRVDSKIRVPVRYCMLGSRDLARNPHTLVEVTSFAAINKFQPFNVAVSSNVLFLLVCGPPCLGARGSGAQSVGSGRGSPAYQLHESWGLVCFVCYWYTVGAQ

SEQ ID NO: 31761 - protein, 109 aa, Homo sapiens
  ENSP00000469057
DFHSHLTRSEVVGYLGGRWDVNSQMLTVLRAFPCRSRLGDAETAAAIEEEMLLVEFYKGSPDLVRLQEPWSQEHTYLDKLKISLASRTPKDQSLCHVLEQVCGVLKQGS

SEQ ID NO: 31762 - protein, 217 aa, Homo sapiens
  ENSP00000395859
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQ

SEQ ID NO: 31763 - protein, 540 aa, Homo sapiens
  ENSP00000222644
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 31764 - protein, 428 aa, Homo sapiens
  ENSP00000386262
MNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 31765 - protein, 540 aa, Homo sapiens; identical to SEQ ID NO: 31763
  ENSP00000379737

SEQ ID NO: 31766 - protein, 307 aa, Homo sapiens
  ENSP00000391020
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKK

SEQ ID NO: 31767 - protein, 41 aa, Homo sapiens
  ENSP00000400515
MQQVLENLTELPSSTGAEEIDLIFLKGIMENPIVKSLAKGL

SEQ ID NO: 31768 - protein, 64 aa, Homo sapiens
  ENSP00000473560
  MOD_RES (1)..(1): Any amino acid
XSGPFCGTISSKKKKKMMYLTTRNAVAEDDRNKKQLYESEISGGLIKGVGNFKSTFLTSELPLC

SEQ ID NO: 31769 - protein, 41 aa, Homo sapiens; identical to SEQ ID NO: 31767
  ENSP00000487215

SEQ ID NO: 31770 - protein, 576 aa, Homo sapiens
  ENSP00000364884
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVAFNELKTTFDKLETETHWVPVSWLHS

SEQ ID NO: 31771 - protein, 454 aa, Homo sapiens
  ENSP00000473899
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKYVDIFENFHVTVFYKHMPVPF

SEQ ID NO: 31772 - protein, 576 aa, Homo sapiens; identical to SEQ ID NO: 31770
  ENSP00000364871

SEQ ID NO: 31773 - protein, 312 aa, Homo sapiens
  ENSP00000398319
MPALSTGSGSDTGLYELLAALPAQLQPHVDSQEDLTFLWDMFGEKSLHSLVKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVA

SEQ ID NO: 31774 - protein, 576 aa, Homo sapiens; identical to SEQ ID NO: 31770
  ENSP00000337907

SEQ ID NO: 31775 - protein, 326 aa, Homo sapiens
  ENSP00000388137
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 31776 - protein, 119 aa, Homo sapiens
  ENSP00000335568
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDF

SEQ ID NO: 31777 - protein, 74 aa, Homo sapiens
  ENSP00000401378
MWRSRWDASVLKAEALALLPCGLGMAFSQSHVMAARRHQHSRLIIEVDEYSSNPTQAFTFYNINQGRFQPPHVQ

SEQ ID NO: 31778 - protein, 326 aa, Homo sapiens; identical to SEQ ID NO: 31775
  ENSP00000400686

SEQ ID NO: 31779 - protein, 248 aa, Homo sapiens
  ENSP00000431538
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 31780 - protein, 248 aa, Homo sapiens; identical to SEQ ID NO: 31779
  ENSP00000432943

SEQ ID NO: 31781 - protein, 52 aa, Homo sapiens
  ENSP00000431441
MEKGKLHKPGKDASKRGRQTPVLYAMLDHSRSTKAVSEKKAKGLGESRKDKK

SEQ ID NO: 31782 - protein, 136 aa, Homo sapiens
  ENSP00000488104
  MOD_RES (1)..(1): Any amino acid
XPYIDEVGTFKERIQWVGDPRWKDGSIVIHNLDYSDNVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 31783 - protein, 205 aa, Homo sapiens
  ENSP00000257776
MSAQRLISNRTSQQSASNSDYTWEYEYYEIGPVSFEGLKAHKYSIVIGFWVGLAVFVIFMFFVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 31784 - protein, 343 aa, Homo sapiens
  ENSP00000309782
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 31785 - protein, 104 aa, Homo sapiens
  ENSP00000323414
MAGNCSWEAHPGNRNKVSATGGGPWSCPDGCGWEGQTQPSISSPIPPFLAPLSSSGPTVGSGLLWAMWPGTSSLDPPTLLSSSVRQAPGLDLKVPRCADTVVAL

SEQ ID NO: 31786 - protein, 343 aa, Homo sapiens; identical to SEQ ID NO: 31784
  ENSP00000403660

SEQ ID NO: 31787 - protein, 46 aa, Homo sapiens
  ENSP00000488429
MTGKNWILISTTTPKSLEDEIVGRLLKILFVIFVDLISIIYVVITS

SEQ ID NO: 31788 - protein, 46 aa, Homo sapiens; identical to SEQ ID NO: 31787
  ENSP00000488299

SEQ ID NO: 31789 - protein, 46 aa, Homo sapiens; identical to SEQ ID NO: 31787
  ENSP00000488748

SEQ ID NO: 31790 - protein, 46 aa, Homo sapiens; identical to SEQ ID NO: 31787
  ENSP00000488584

SEQ ID NO: 31791 - protein, 1 aa, Homo sapiens
  ENSP00000488673
M

SEQ ID NO: 31792 - protein, 1 aa, Homo sapiens
  ENSP00000487738
M

SEQ ID NO: 31793 - protein, 246 aa, Homo sapiens
  ENSP00000242257
MAGYLKLVCVSFQRQGFHTVGSRCKNRTGAEHLWLTRHLRDPFVKAAKVESYRCRSAFKLLEVNERHQILRPGLRVLDCGAAPGAWSQVAVQKVNAAGTDPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 31794 - protein, 152 aa, Homo sapiens
  ENSP00000384423
MRPPADPSSPVGFVLGVDLLHIFPLEGATFLCPADVTDPRTSQRILEVLPGRRADVILSDMAPNATGFRDLDHDRLISLCLTLLSVTPDILQPGGTFLCKTWAGSQSRRLQRRLTEEFQNVRIIKPEASRKESSEVYFLATQYHGRKGTVKQ

SEQ ID NO: 31795 - protein, 246 aa, Homo sapiens; identical to SEQ ID NO: 31793
  ENSP00000392343

SEQ ID NO: 31796 - protein, 180 aa, Homo sapiens [sequence omitted]

SEQ ID NO: 31797 - protein, 362 aa, Homo sapiens
  ENSP00000257552
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 31798 - protein, 233 aa, Homo sapiens
  ENSP00000446710
  MOD_RES (1)..(1): Any amino acid
XDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPAIPLTAYGPMAAAAAAAAVVRGTGSHPWTMAPPPGSTPSRTGGFLGTTSPGPMAELY

SEQ ID NO: 31799 - protein, 293 aa, Homo sapiens
  ENSP00000261507
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 31800 - protein, 220 aa, Homo sapiens
  ENSP00000425241
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIR

SEQ ID NO: 31801 - protein, 162 aa, Homo sapiens
  ENSP00000377361
MPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 31802 - protein, 229 aa, Homo sapiens
  ENSP00000423633
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHR

SEQ ID NO: 31803 - protein, 85 aa, Homo sapiens
  ENSP00000425112
MATNESVSIFSSASLAVEYVDSLLPENPLQEPFKNAWNYMLNNYTKFQIATWGSLIVHEALYFLFCLPGFLFQFIPYMKKYKIQK

SEQ ID NO: 31804 - protein, 235 aa, Homo sapiens
  ENSP00000313921
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 31805 - protein, 195 aa, Homo sapiens
  ENSP00000410912
MLSATRRACQLLLLHSLFPVPRMGNSASNIVSPQEALPGRKEQTPVAAKHHVNGNRTVEPFPEGTQMAVFEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 31806 - protein, 213 aa, Homo sapiens
  ENSP00000429461
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKLVLPCSSSAMLGLTAASSAQLAWVQPSSRKHY

SEQ ID NO: 31807 - protein, 59 aa, Homo sapiens
  ENSP00000435644
MAVFGMGCFWGAERKFWVLKGVYSTQVGFAGGYTSNPTYKEVCSDVQNNSMFISLFKSF

SEQ ID NO: 31808 - protein, 82 aa, Homo sapiens
  ENSP00000428214
MAVFGMGCFWGAERKFWVLKGVYSTQVGFAGGYTSNPTYKEVCSEKTGHAEVVRVVYQPEHMSFEELLKVFWENHDPTQGMR

SEQ ID NO: 31809 - protein, 169 aa, Homo sapiens
  ENSP00000436839
MAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 31810 - protein, 192 aa, Homo sapiens
  ENSP00000371930
MCSEPKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 31811 - protein, 91 aa, Homo sapiens
  ENSP00000427725
  MOD_RES (1)..(1): Any amino acid
XKTGHAEVVRVVYQPEHMSFEELLKVFWENHDPTQGMRQGNDHGTQYRSAIYPTSAKQMEAALSSKENYQKVPKHVHWKKRTQTGLQTEGR

SEQ ID NO: 31812 - protein, 267 aa, Homo sapiens
  ENSP00000239243
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHMSPTTCTLRKHKTNRKPRTPFTTSQLLALERKFRQKQYLSIAERAEFSSSLNLTETQVKIWFQNRRAKAKRLQEAELEKLKMAAKPMLPSSFSLPFPISSPLQAASIYGASYPFHRPVLPIPPVGLYATPVGYGMYHLS

SEQ ID NO: 31813 - protein, 134 aa, Homo sapiens
  ENSP00000427425
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPSECAPGQE

SEQ ID NO: 31814 - protein, 513 aa, Homo sapiens
  ENSP00000354499
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 31815 - protein, 459 aa, Homo sapiens
  ENSP00000354961
MLKLIVPTIMLLPLTWLSKKHMIWINTTTHSLIISIIPLLFFNQINNNLFSCSPTFSSDPLTTPLLMLTTWLLPLTIMASQRHLSSEPLSRKKLYLSMLISLQISLIMTFTATELIMFYIFFETTLIPTLAIITRWGNQPERLNAGTYFLFYTLVGSLPLLIALIYTHNTLGSLNILLLTLTAQELSNSWANNLMWLAYTMAFMVKMPLYGLHLWLPKAHVEAPIAGSMVLAAVLLKLGGYGMMRLTLILNPLTKHMAYPFLVLSLWGMIMTSSICLRQTDLKSLIAYSSISHMALVVTAILIQTPWSFTGAVILMIAHGLTSSLLFCLANSNYERTHSRIMILSQGLQTLLPLMAFWWLLASLANLALPPTINLLGELSVLVTTFSWSNITLLLTGLNMLVTALYSLYMFTTTQWGSLTHHINNMKPSFTRENTLMFMHLSPILLLSLNPDIITGFSS

SEQ ID NO: 31816 - protein, 73 aa, Homo sapiens
  ENSP00000456804
MDPNCSCAAGDSCTCAGSCKCKECKCTSCKKSKWDPLFPLPLPCPPACPLSTILRGIKAVWGCPIARKLLPPQ

SEQ ID NO: 31817 - protein, 61 aa, Homo sapiens
  ENSP00000245185
MDPNCSCAAGDSCTCAGSCKCKECKCTSCKKSCCSCCPVGCAKCAQGCICKGASDKCSCCA

SEQ ID NO: 31818 - protein, 113 aa, Homo sapiens
  ENSP00000455353
MKGKRGREELGNTQSAFFSTFGDAKPRVQLLGEARSPPPAAALLDMDPETCPCPSGGSCTCADSCKCEGCKCTSCKKSCCSCCPAECEKCAKDCVCKGGEAAEAEAEKCSCCQ

SEQ ID NO: 31819 - protein, 81 aa, Homo sapiens
  ENSP00000455980
MKGKRGREELGNTQSAFFSTFGDGGSCTCADSCKCEGCKCTSCKKSCCSCCPAECEKCAKDCVCKGGEAAEAEAEKCSCCQ

SEQ ID NO: 31820 - protein, 68 aa, Homo sapiens
  ENSP00000200691
MDPETCPCPSGGSCTCADSCKCEGCKCTSCKKSCCSCCPAECEKCAKDCVCKGGEAAEAEAEKCSCCQ

SEQ ID NO: 31821 - protein, 92 aa, Homo sapiens
  ENSP00000457164
MDPETCPCPSGGSCTCADSCKCEGCKCTSCKKSECGDPSPLPPPPLLCGVGVSPRRMWRDSQAPIPWFLTLAGIEPPGQTLKYRCPCPTPRN

SEQ ID NO: 31822 - protein, 372 aa, Homo sapiens
  ENSP00000362718
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 31823 - protein, 389 aa, Homo sapiens
  ENSP00000362730
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 31824 - protein, 201 aa, Homo sapiens
  ENSP00000399187
  MOD_RES (1)..(1): Any amino acid
XAVCVPHVGPPPACHLNALHGPVCGTGGQVQLSCGATIPGSSAAMVPHFGVINGKLAHSPRLIMSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFA

SEQ ID NO: 31825 - protein, 394 aa, Homo sapiens
  ENSP00000419739
AGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 31826 - protein, 303 aa, Homo sapiens
  ENSP00000303222
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 31827 - protein, 262 aa, Homo sapiens
  ENSP00000432043
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCM

SEQ ID NO: 31828 - protein, 166 aa, Homo sapiens
  ENSP00000266263
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 31829 - protein, 135 aa, Homo sapiens
  ENSP00000347267
MSEPQPRGAERDLYRDTWVRYLGYANEVGEAFRSLVPAAVVWLSYGVASSYVLADAIDKGKKAGEVGGFPPGLQPAQALPNSGEAQLLLIILWYLACASASCFMSTSYSCQGMWTPGSLVSKDPGTWVGLSWTEA

SEQ ID NO: 31830 - protein, 74 aa, Homo sapiens
  ENSP00000393954
MSEPQPRGAERDLYRDTWVRYLGYANEVGEAFRSLVPAAVVWLSYGVASSYVLADAIDKGKKAGEDFLPLPQLD

SEQ ID NO: 31831 - protein, 143 aa, Homo sapiens
  ENSP00000383926
MSEPQPRGAERDLYRDTWVRYLGYANEVGEAFRSLVPAAVVWLSYGVASSYVLADAIDKGKKAGEALASVAIPGFTINRVCAASLYVLGTATRWPLAVRKWTTTALGLLTIPIIIHPIDRSVDFLLDSSLRKLYPTVGKPSSS

SEQ ID NO: 31832 - protein, 74 aa, Homo sapiens; identical to SEQ ID NO: 31830
  ENSP00000487369

SEQ ID NO: 31833 - protein, 978 aa, Homo sapiens
  ENSP00000356290
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 31834 - protein, 275 aa, Homo sapiens
  ENSP00000356276
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKTESRSVTRLECRRVI

SEQ ID NO: 31835 - protein, 332 aa, Homo sapiens
  ENSP00000356277
  MOD_RES (1)..(1): Any amino acid
XGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTP

SEQ ID NO: 31836 - protein, 108 aa, Homo sapiens
  ENSP00000407070
MQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSASRG

SEQ ID NO: 31837 - protein, 114 aa, Homo sapiens
  ENSP00000400776
MQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKIL

SEQ ID NO: 31838 - protein, 96 aa, Homo sapiens
  ENSP00000395158
NIQLVADGCCNLQKQIQITQLFGVPVVVALNVFKTDTRAEIDLVCELAKRAGAFDAVPCYHWSVGGKGSVDLARAVREAASKRSRFQFLYDVQPFS

SEQ ID NO: 31839 - protein, 92 aa, Homo sapiens
  ENSP00000391022
VYGAKDIELSPEAQAKIDRYTQQGFGNLPICMAKTHLSLSHQPDKKGVPRDFILPISDVRASIGAGFIYPLVGTRSSPLALVGESQPKQVHP

SEQ ID NO: 31840 - protein, 57 aa, Homo sapiens
  ENSP00000399804
NLPICMAKTHLSLSHQPDKKGVPRDFILPISDVRASIGAGFIYPLVGTGGREAPLWL

SEQ ID NO: 31841 - protein, 913 aa, Homo sapiens
  ENSP00000479539
MQSRRARPRREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 31842 - protein, 979 aa, Homo sapiens
  ENSP00000478253
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 31843 - protein, 223 aa, Homo sapiens
  ENSP00000391327
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 31844 - protein, 106 aa, Homo sapiens
  ENSP00000409391
MAKHIQKEIQRGVESWVSLGNRRPHLSIILVGDNPASHTYVRNKIRAASAVGICSELILKPKDVSQEELLDVTDQLNMDPRVSGILVQLPLPEAVQLCSGFEMLGI

SEQ ID NO: 31845 - protein, 106 aa, Homo sapiens; identical to SEQ ID NO: 31844
  ENSP00000387614

SEQ ID NO: 31846 - protein, 252 aa, Homo sapiens
  ENSP00000352012
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFE

SEQ ID NO: 31847 - protein, 289 aa, Homo sapiens
  ENSP00000321984
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 31848 - protein, 347 aa, Homo sapiens
  ENSP00000379108
MTVPVRGFSLLRGRLGRAPALGRSTAPSVRAPGEPGSAFRGFRSSGVRHEAIIISGTEMAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 31849 - protein, 146 aa, Homo sapiens
  ENSP00000405692
MDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 31850 - protein, 383 aa, Homo sapiens
  ENSP00000354152
MEPRAVGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 31851 - protein, 220 aa, Homo sapiens
  ENSP00000438761
MMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 31852 - protein, 382 aa, Homo sapiens
  ENSP00000489295
MEPRAGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 31853 - protein, 382 aa, Homo sapiens
  ENSP00000444003
MEPRAGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 31854 - protein, 383 aa, Homo sapiens
  ENSP00000370612
MEPRAVGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 31855 - protein, 84 aa, Homo sapiens
  ENSP00000456910
MEPRAVGVSKQDIREQIWGYMESQNLADFPRPVHHRIPNFKGSYLACQNIKDLDVFARTQEVKVDPDKPLEGVRLLVLQVIPLP

SEQ ID NO: 31856 - protein, 56 aa, Homo sapiens
  ENSP00000454593
MEPRAGVSKQDIREQIWGYMESQNLADFPRPVHHRIPNFKAGESGREKATPIWNMP

SEQ ID NO: 31857 - protein, 223 aa, Homo sapiens
  ENSP00000456652
GVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKIR

SEQ ID NO: 31858 - protein, 233 aa, Homo sapiens
  ENSP00000455940
  MOD_RES (1)..(1): Any amino acid
XVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKVGHGSGQLWPVA

SEQ ID NO: 31859 - protein, 174 aa, Homo sapiens
  ENSP00000454807
MEPRAGVSKQDIREQIWGYMESQNLADFPRPVHHRIPNFKSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIAT

SEQ ID NO: 31860 - protein, 106 aa, Homo sapiens
  ENSP00000455262
MEPRAVGVSKQDIREQIWGYMESQNLADFPRPVHHRIPNFKSKKTLLVPTPRLRTGLFNKITPPPGATKDILRKCATSQVPPERLGRQDRISKTCSIGNCLTSSKV

SEQ ID NO: 31861 - protein, 18 aa, Homo sapiens
  ENSP00000456628
MMVSMGAVSKETPVVTIV

SEQ ID NO: 31862 - protein, 16 aa, Homo sapiens
  ENSP00000454429
MMVSMGAVSKETPVVT

SEQ ID NO: 31863 - protein, 112 aa, Homo sapiens
  ENSP00000458104
MESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRV

SEQ ID NO: 31864 - protein, 152 aa, Homo sapiens
  ENSP00000480673
PRAVGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQVPPERLGRQDRISKTCSIGNCLTSSNWSVPAPVDPAR

SEQ ID NO: 31865 - protein, 112 aa, Homo sapiens
  ENSP00000455208
MESQNLADFPRPVHHRIPNFKGSYLACQNIKDLDVFARTQEVKVDPDKPLEGVRLLVLQSKKTLLVPTPRLRTGLFNKITPPPGATKDILRKCATSQVPPERLGRQDRISKT

SEQ ID NO: 31866 - protein, 89 aa, Homo sapiens
  ENSP00000457794
MESQNLADFPRPVHHRIPNFKGSYLACQNIKDLDVFARTQEVKVDPDKPLEGVRLLVLQSKKTLLVPTPRLRTGLFNKITPPPGATKDI

SEQ ID NO: 31867 - protein, 445 aa, Homo sapiens
  ENSP00000368793
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 31868 - protein, 445 aa, Homo sapiens; identical to SEQ ID NO: 31867
  ENSP00000368790

SEQ ID NO: 31869 - protein, 151 aa, Homo sapiens
  ENSP00000481161
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKKTESCSVAQAGMQ

SEQ ID NO: 31870 - protein, 137 aa, Homo sapiens
  ENSP00000482339
RRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGRHIEEFACRRY

SEQ ID NO: 31871 - protein, 226 aa, Homo sapiens
  ENSP00000399279
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLN

SEQ ID NO: 31872 - protein, 153 aa, Homo sapiens
  ENSP00000484414
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKRDRVLLCGPGWNAVV

SEQ ID NO: 31873 - protein, 151 aa, Homo sapiens; identical to SEQ ID NO: 31869
  ENSP00000400031

SEQ ID NO: 31874 - protein, 24 aa, Homo sapiens
  ENSP00000488809
MTPRGFSCLLLPTSETDLPVKRRT

SEQ ID NO: 31875 - protein, 24 aa, Homo sapiens
  ENSP00000473686
MTPRGFSCLLLPTSETDLPVKRRT

SEQ ID NO: 31876 - protein, 24 aa, Homo sapiens
  ENSP00000439666
MAPRGFSCLLLSTSEIDLPVKRRA

SEQ ID NO: 31877 - protein, 730 aa, Homo sapiens
  ENSP00000367256
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31878 - protein, 755 aa, Homo sapiens
  ENSP00000429064
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31879 - protein, 543 aa, Homo sapiens
  ENSP00000428685
  MOD_RES (1)..(1): Any amino acid
XWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31880 - protein, 759 aa, Homo sapiens
  ENSP00000322804
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKVDTLGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31881 - protein, 473 aa, Homo sapiens
  ENSP00000393606
MLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31882 - protein, 645 aa, Homo sapiens
  ENSP00000428319
MNKYFFYILENCGFDSSKDPREEGHLFQKLVFQQAVLGSLFFAGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 31883 - protein, 286 aa, Homo sapiens
  ENSP00000428348
  MOD_RES (1)..(1): Any amino acid
XGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQDWAKPGPYDQPLVNTLQRRKEKREPDPNGGGPTTASGPPAAAEEAQRPRSMTVSAATRPGEEMEACEELALALSRGLQLDTQRSSRDSLQCSS

SEQ ID NO: 31884 - protein, 207 aa, Homo sapiens
  ENSP00000428145
MLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIP

SEQ ID NO: 31885 - protein, 184 aa, Homo sapiens
  ENSP00000429752
  MOD_RES (1)..(1): Any amino acid
XSLGGSRHWLQVFPLSVPEGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALI

SEQ ID NO: 31886 - protein, 42 aa, Homo sapiens
  ENSP00000424972
MARAPLRPENTIVRGSANQCQDTYRAEELTGSEEGHSLTGCH

SEQ ID NO: 31887 - protein, 55 aa, Homo sapiens
  ENSP00000425987
MARAPLRPENTIVRGSANQCQDTYRAEELTGRPSIITRIHKTEEGDRRDGQSDMK

SEQ ID NO: 31888 - protein, 178 aa, Homo sapiens
  ENSP00000426755
MARAPLRPENTIVRGSANQCQDTYRAEELTGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEV

SEQ ID NO: 31889 - protein, 59 aa, Homo sapiens
  ENSP00000425642
MEERGGVYAGRGLELVFWEWEVVTVMSVFSRSRIKCVPADVYSFIYSCSEEGHSLTGCH

SEQ ID NO: 31890 - protein, 56 aa, Homo sapiens
  ENSP00000422667
MEERGGVYAGRGLELVFWEWEVVTVMSVFSRSRIKCVPADVYSFIYSCEYWMKELR

SEQ ID NO: 31891 - protein, 72 aa, Homo sapiens
  ENSP00000422178
MEERGGVYAGRGLELVFWEWEVVTVMSVFSRSRIKCVPADVYSFIYSCRPSIITRIHKTEEGDRRDGQSDMK

SEQ ID NO: 31892 - protein, 50 aa, Homo sapiens
  ENSP00000422782
MEERGGVYAGRGLELVFWEWEVVTVMSVFSRSRIKCVPADVYSFIYSCPV

SEQ ID NO: 31893 - protein, 921 aa, Homo sapiens
  ENSP00000427679
MEERGGVYAGRGLELVFWEWEVVTVMSVFSRSRIKCVPADVYSFIYSCHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 31894 - protein, 894 aa, Homo sapiens
  ENSP00000265517
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 31895 - protein, 151 aa, Homo sapiens
  ENSP00000407350
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKGRLDSTTFSPTSYFSSLQ

SEQ ID NO: 31896 - protein, 894 aa, Homo sapiens; identical to SEQ ID NO: 31894
  ENSP00000400821

SEQ ID NO: 31897 - protein, 220 aa, Homo sapiens
  ENSP00000455819
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVI

SEQ ID NO: 31898 - protein, 893 aa, Homo sapiens
  ENSP00000349977
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 31899 - protein, 81 aa, Homo sapiens
  ENSP00000455741
MATEEFIIRIPPYHYIHVLDQNSNVSRVEVGPKTYIRQDNERFWIWWTPSSLRKRQPCTSGLGGTSGTSGECPAALGRSGW

SEQ ID NO: 31900 - protein, 94 aa, Homo sapiens
  ENSP00000455186
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQ

SEQ ID NO: 31901 - protein, 57 aa, Homo sapiens
  ENSP00000457734
MATEEFIIRIPPYHYIHVLDQNSNVSRVEVGPKTYIRQDNERTSHPCRWFCPTLPSI

SEQ ID NO: 31902 - protein, 144 aa, Homo sapiens
  ENSP00000454825
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKAIPLDENEGIYVQDVKTGKVRAVIGSTYMLTQDEVLW

SEQ ID NO: 31903 - protein, 39 aa, Homo sapiens
  ENSP00000455532
MATEEFIIRIPPYHYIHVLDQNSNVSRVECPAALGRSGW

SEQ ID NO: 31904 - protein, 42 aa, Homo sapiens
  ENSP00000454819
MATEEFIIRIPPYHYIHVLDQNSNVSRVEVGPKTYIRQDNER

SEQ ID NO: 31905 - protein, 148 aa, Homo sapiens
  ENSP00000456291
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGP

SEQ ID NO: 31906 - protein, 107 aa, Homo sapiens
  ENSP00000457685
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEK

SEQ ID NO: 31907 - protein, 61 aa, Homo sapiens
  ENSP00000458583
  MOD_RES (1)..(1): Any amino acid
XGDEWLFEGPGTYIPRKEVEVVEIIQATIIRQNQALRLRARKECWDRDGKERVTGGVTKGR

SEQ ID NO: 31908 - protein, 893 aa, Homo sapiens; identical to SEQ ID NO: 31898
  ENSP00000378760

SEQ ID NO: 31909 - protein, 39 aa, Homo sapiens; identical to SEQ ID NO: 31903
  ENSP00000486166

SEQ ID NO: 31910 - protein, 181 aa, Homo sapiens
  ENSP00000410672
MLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQD

SEQ ID NO: 31911 - protein, 221 aa, Homo sapiens
  ENSP00000264444
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 31912 - protein, 73 aa, Homo sapiens
  ENSP00000386523
MLPYNNKDRDALKRRNKSKKNNSSSRRAHLRLCLEKLKGLVPLGPESSRHTTLSLLTKAKLHIKDKYPQHWRC

SEQ ID NO: 31913 - protein, 211 aa, Homo sapiens
  ENSP00000443935
MAAAVRMNIQMLLEAADYLERREREAEHGYASMLPYNNKDRDALKRRNKSKKNNSSSRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 31914 - protein, 209 aa, Homo sapiens
  ENSP00000337889
MELNSLLILLEAAEYLERRDREAEHGYASVLPFDGDFAREKTKAAGLVRKAPNNRSSHNELEKHRRAKLRLYLEQLKQLVPLGPDSTRHTTLSLLKRAKVHIKKLEEQDRRALSIKEQLQQEHRFLKRRLEQLSVQSVERVRTDSTGSAVSTDDSEQEVDIEGMEFGPGELDSVGSSSDADDHYSLQSGTGGDSGFGPHCRRLGRPALS

SEQ ID NO: 31915 - protein, 82 aa, Homo sapiens
  ENSP00000422660
  MOD_RES (1)..(1): Any amino acid
XLPFDGDFAREKTKAAGLVRKAPNNRSSHNELEKHRCSVISKAVCSRTSPAPHPRDRIPGTQRLSHILHCSPRALTLPMRLG

SEQ ID NO: 31916 - protein, 107 aa, Homo sapiens
  ENSP00000421209
MELNSLLILLEAAEYLERRDREAEHGYASVLPFDGDFAREKTKAAGLVRKAPNNSGILGGPGALAGLWGPAWTRKVAWSWERGPPASLSSRQMLWHTLWCWELCARV

SEQ ID NO: 31917 - protein, 442 aa, Homo sapiens
  ENSP00000307887
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 31918 - protein, 450 aa, Homo sapiens
  ENSP00000399229
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLASSPPTDYKNNILKERAELAHSPLPAKYIDLDKDPSGLCPLGA

SEQ ID NO: 31919 - protein, 433 aa, Homo sapiens
  ENSP00000436135
MIRCAATGSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 31920 - protein, 341 aa, Homo sapiens
  ENSP00000344998
MALPSRILLWKLVLLQSSAVLLHSAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 31921 - protein, 1120 aa, Homo sapiens
  ENSP00000448175
MPEPTKKEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 31922 - protein, 1173 aa, Homo sapiens
  ENSP00000400908
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQVGSPSADSSCKAYLQT

SEQ ID NO: 31923 - protein, 1139 aa, Homo sapiens
  ENSP00000376665
MPEPTKKEDEEEVSPPSALPPDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSFCRLLLQGVPPNIIDSYLRDLHSSNPEEY

SEQ ID NO: 31924 - protein, 1132 aa, Homo sapiens
  ENSP00000447362
MPEPTKKEENEVPAPAPPPEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 31925 - protein, 1148 aa, Homo sapiens
  ENSP00000354845
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 31926 - protein, 1154 aa, Homo sapiens
  ENSP00000447660
MPEPTKKEENEVPAPAPPPEEPSKEKEAGTTPAKDEEEVSPPSALPPDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 31927 - protein, 1123 aa, Homo sapiens
  ENSP00000447900
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 31928 - protein, 1146 aa, Homo sapiens
  ENSP00000440034
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 31929 - protein, 1127 aa, Homo sapiens
  ENSP00000446128
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF
